United States Patent 7,745,391 (HUMAN THROMBOSPONDIN POLYPEPTIDE) - sequence listing, part 263

SEQ ID NO: 737381 - DNA, 8204 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacatgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgattttaaaaaaagtttcctaggaagtatctctgaggaacagcaatctgaagaactgactatattctcatgctaagtcattagccaaaagctggtggtattgttgcatgctgctattgcatattaaaacgtagcagatgaataatagttgtaatgcagcaggatagttggtcaaattatttttttagg

SEQ ID NO: 737382 - DNA, 7610 bp, Homo sapiens
  misc_feature (2941)..(2941): n is a, c, g, or t
  misc_feature (7486)..(7486): n is a, c, g, or t
  misc_feature (7507)..(7507): n is a, c, g, or t
  misc_feature (7515)..(7515): n is a, c, g, or t
  misc_feature (7522)..(7522): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcaggatggataagttctgaagatctattgaatagcatggngactacagtgaataatgtttngtgtattngaaaatngctaggagagtggatcttaaatggtctccccacaaaaatgacaagtatgtgaggtgacagatatgttaatgagcttgatttaatcact

SEQ ID NO: 737383 - DNA, 8910 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgattttaaaaaaagtttcctaggaagtatctctgaggaacagcaatctgaagaactgactatattctcatgctaagtcattagccaaaagctggtggtattgttgcatgctgctattgcatattaaaacgtagcagatgaataatagttgtaatgcagcaggatagttggtcaaattatttttttagg

SEQ ID NO: 737384 - DNA, 9261 bp, Homo sapiens
  misc_feature (2941)..(2941): n is a, c, g, or t
  misc_feature (8378)..(8378): n is a, c, g, or t
  misc_feature (8977)..(8977): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgttctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagggtcttattgtatgagtacattgcaatttgttcaattctctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaatagttttagcagtttggtgtgattacacagagcacatgcatattaaccaaaataagatcatattatataccattgtataattttttctttttattaccaaattggtacattgaatactacttcacctttttatggctgcttagtgttccattttattatgattttaataactcccaattgatgaacattggggttgttcccaaatttcccctattatgggtaaagttatgttcataatgtctagctatatttctgtgtacatttataatctttaggctaaattcctggaggtagaattgctagatccacatgtatgcacagtttaaaggtgctttttcatagcaatttatggccccaagaaagtgagagtgagtgtctttgtttatgttgctatgaaaggacacctggagctgggtaatttataaagaaaagaggtttatttggctcactgttctgtgggctatgaaagaagcatggtgccggcatctgtttctagtgagggcttcaggctgtttctactcatggtggaaggtgaaggggggagcctgtgtgtgcagatcacctggcaagagaggaagaaggaaagagggaggaggaggagaggaggtagtgggctttttttttaataatcaaggaaccaatagagggataactcattactgaaaggacagtggcaccaagccattcattagggattggctcccatgacccaaacacctctctctagaattcacctcaaacattggggatcaaatttcaatatgaaatttgggaggacagatatctaaaccatagcagtgagtttccatctttcctcacaaaaacaatggctgtcatcatttaaaatagattttatgcagtttgtctagttaagcaacaatttgttcttgtaaattgtatttaaaaagttatcgttaagccaggcgctgtggctcacacctgtaaccccagcaccttgggaggccacagcaggcagatcgctagagcttacgagtttgagaccaccctgggcaatatggtgaaacctcgtctctacaaaaaatggaaaaattagccagaaggtggcacgtgcacctgtagtccccgctacttgggagacngaagtgggaggatggcttgagtctgggaggcagaggttgcagtgagccaaagtcacaccacttcactctaggcgatagagccatacctcgtctctaaaacaaaaacaacagcaaaaaaattattgttgagggtgaaccttcatttatatggatattggcacttgtgctttcttcagttgtcttctgtgcacagcatactttgagttctactcaaggcttgagtcttgttacagtgattaaaactggctgaaaggtgagcctgttgaataccacaagtaatatttaggaatacttagtcaaaatatagtcaaaagaaatgaaagagttatctatcttttgatctttcttcctgaaaatttggtccaaggcaaataccttataatcctatttaaagaatattcacaggctgggttcagtggtaatctcagcactttttaaggcccaaggtgggtgaatcacttgaagccagggtttgagactagtctggtcaacatgacaaaaccctatctctactaaaaatgcaaaaattagcttggtgtggtggggtacacctgtaatcccagctacttgggtgcatgaggcctgagaatcacttgagnccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgggaggccaaggtgggtggatcacctgatgtcaggagttcgagatcagcctggcaaacatggtgaaacctcatctctactaaaaatac

SEQ ID NO: 737385 - DNA, 8684 bp, Homo sapiens
  misc_feature (2941)..(2941): n is a, c, g, or t
  misc_feature (8400)..(8400): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgttctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagggtcttattgtatgagtacattgcaatttgttcaattctctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaatagttttagcagtttggtgtgattacacagagcacatgcatattaaccaaaataagatcatattatataccattgtataattttttctttttattaccaaattggtacattgaatactacttcacctttttatggctgcttagtgttccattttattatgattttaataactcccaattgatgaacattggggttgttcccaaatttcccctattatgggtaaagttatgttcataatgtctagctatatttctgtgtacatttataatctttaggctaaattcctggaggtagaattgctagatccacatgtatgcacagtttaaaggtgctttttcatagcaatttatggccccaagaaagtgagagtgagtgtctttgtttatgttgctatgaaaggacacctggagctgggtaatttataaagaaaagaggtttatttggctcactgttctgtgggctatgaaagaagcatggtgccggcatctgtttctagtgagggcttcaggctgtttctactcatggtggaaggtgaaggggggagcctgtgtgtgcagatcacctggcaagagaggaagaaggaaagagggaggaggaggagaggaggtagtgggctttttttttaataatcaaggaaccaatagagggataactcattactgaaaggacagtggcaccaagccattcattagggattggctcccatgacccaaacacctctctctagaattcacctcaaacattggggatcaaatttcaatatgaaatttgggaggacagatatctaaaccatagcagtgagtttccatctttcctcacaaaaacaatggctgtcatcatttaaaatagattttatgcagtttgtctagttaagcaacaatttgttcttgtaaattgtatttaaaaagttatcgttaagccaggcgctgtggctcacacctgtaaccccagcaccttgggaggccacagcaggcagatcgctagagcttacgagtttgagaccaccctgggcaatatggtgaaacctcgtctctacaaaaaatggaaaaattagccagaaggtggcacgtgcacctgtaatcccagctacttgggtgcatgaggcctgagaatcacttgagnccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgggaggccaaggtgggtggatcacctgatgtcaggagttcgagatcagcctggcaaacatggtgaaacctcatctctactaaaaatac

SEQ ID NO: 737386 - DNA, 9076 bp, Homo sapiens
  misc_feature (2941)..(2941): n is a, c, g, or t
attcaatcgtaattttttaatcaattaaatccaccagctaactaatcacagctaacagttactgaaagtcaggtataatagtgctctgtcagacagaagagaaacagaacatgctcttgagggacatacaatctagtaggagaacgcagacatactgaaaacattaaggtatgatccctgagaatgctaagtagagcacagttataagtgggacagcattacggggaagggcaaaatcactgctaatgggtatgggggtaggggtgttcacgcagttaggcttcatgggaaagtgggatttaagttgggcctggaaggatggtaagggcaggaggatattggcgcccagggatcagaaggcacagaggtggccgttagcaagttgctaagtggaggaagcctgataagaagaggtgtgtgctgaggagtgctgaggagtcgaggctgctaaaacagatgctgtggcaggcagcagggagccactgaggtctgtggagccttgggcaccatgacacgactggtatgttgtaatgttctgccccatgccaagccatattagagcctgggacaaaaggaaaactcagtaatactaatcctgtctttattttaaattttaatattttgttcatcatggttttttttgcattaattctgatttttaaaaatattggattgaaatattacttactttgattactgtatttttttggcatcccttacattttgtgcccaaggccagggtctcccttgcctcatcctagtcccagtcatgagttctacttctgaagtccagtggtgggtacatgggtatttatttcattgttattaattatagcttactcatgttataaatattatttggttagtaaacagcacttaattaaaaaaacaatgtaaaagacatggattttaagattaattagaaactattgagcctgagaagcatgaaagagaaaagaatccttcgtgctgccaagtcgatctctaggggagaataactcccacggctgcagcgtatgcagtgcacacagaagagggctgctctgcccagtccatgtgggtggaagataactggggggagtaccagaggctgctgtccacttggacactggccttgagcaactcagctgctgcagccagagcgccaatgctgcatggcctgaggcaagccctggcaaatgggctgcccaggtaggcttggcccacgttaaaacagacccacgcagccctgctgaaggaatggaagcaatagaagactcctgaacgctataaatgtctcagggctatgtatcagggagaaaaggagatgtttgatacaaggaatattgttagtacatcttaacatgtaaaatctgaaattttgaaacatgaaatctattgttcattagtataatggtgacgaatgaaagattattttgattcagggaaggcaaacagattgcagcaaaaatctcaaaaaaggtgaggggaaaggttgaaaggggcaggcaggtccctgctcacatcaccaggggcagttctttgtcatatgatgcggacctcccagtcagtggcaatgttgagtgagagcttctccaggctcaggatggatgttttggcacaatacgtaaaagccacaggctgatctttaccatcagatgagtgggtagtcacagaagatggctccttcctgaagcctaagaccaagatcttctccaccacacacttgctgggataatgacccctctggtcagcaaaactattgatcagaacactggaacagaatgaaaacttcctgtgcaaaaattgcttctggtggaggtattggaatgaatggccatcatcaagatataactcacccactgaagaacccttagtgcttagagcaacccggagtccataggaggattcagtcatccagcctgtggattttcctacagttgtctttattggtatcacacttccacctcgctgaaacactggaatagtgtccaaggctactgggatctttacagtacaccctccttcccaatgagcaaatgtcttatagtcataccagacctcatttgatcctggaagaaacacatcaactgtggtggcttttggttctgtgactggatgaaccaataatgcactccccagcatgtattcatcttccatatcaaaagtctttagttcatcagggaactctacccacagaggcctcatgacaggttgggaagccacgtgtgcatggtagaacagagaataccaatatggcaggaggccatagcgctctctgatggcttctcggatgagtcgggtgtgttcctccccaaagagccagggctctcgtcgcttggtgttcatggtggcatggccacggaagaagggctggtaggctccagcctggtaccaacgcactagcagctctgtctctggattcccaatgaacccgcctatgtcagctccgcaaaaagagatcccagtaatgctgagagtgagtaacattgggatagaaattttcaagttgctccattctgctgtgttgtcgcctgtccacacggcaccatacttttgtgatccagcaaagaaagaacgtgtaagaacaaagggtctctccttccctttagatcgttttatcagtccttctgcagtagccatttgatgataaaaaccgtagatgttgtggagctctctgtgctcccaattgccatgatgaatggcattcttctgcatggtttgctctggccctctaaagacagaaggctcattcatgtcattccaaaggaagaggatgtccgtagatccctgataaacagggaaagcaaaaagacttgaataccactctctgaccttgggattggtgaaatccaggtaagaggagagacctggccaacacaccccttcaaagtcttccccttcctgattcttcacaaagaagccctgatctttggccttcacatatactgagtagtcaggntcaatcttgatgtggggatcactgatgaccacaagcttacgctttttgctcctgagcagctcttgcatcctcttggggtttgggaatctgtttttgtcccaggtgaagtacctcttgccctcagtgtgctctatgtccagccacatggcatcataaggaatgtcatgctcatcaaaccctgcatccactgcttttacatcctgctcatcttcatagttccagcggcactggtggtatcccaaagagaaaagagggggcatggcttgtgtgcctgtaaggtgtgagtactgtttgaagacatcagaaggtgtaggtcctgtcagcagaaaaacatcaatgatgccactctctgacatccagtgcacatgagtgcgagatctgaccttttgtttagcagcaactgggcccatctgggtcagtgtgtactctactgcaggctctgtattgatctccaccagtgtttccgaggcattcagccagaaaatacctatagttctgcccagtttgtgggccaggagataaggtactgaaccataaatgcccattttatcatatatttggtatccatagacatccaggttataaagacggtaagcatctccatcaccagtatttttaagttggtgtgattctgcatgttgtgggatcccataaagatgctcaaatccatgcaaggagaaatccaaaccaatagaagaagggccattagctttgatatccacaaattttccaaatttctcttcccacaggcccagatcttcttgattttcctgagaggtgtccactgatgtctcctcctcattttctttagcagctctttgtttgtgaagaatctgtagatgctcaaagtataattggcccagggaatttatgctaatcacaacctcttcttcagacaccaagtctaccttgaatgggtttgctgtgatatggcacttcaggtctccttttccatctgccaatatcagactgcctgtgtccccagagcatgaaatcagccttacagtgcttggcttgcttgtgaggacatccggaacttcaaatctgggttttagaggagtctcttcgttaattttaagcctgaaaatgtttccttctataccataaatttcagccaggagaggaaccttacttgcttcattgatgatttggaacctggtgctgtcttcatctgttgtgactgaatccaataatgcccgataggtggacttcttggaaagccactgtttctgacgcctgtaaaatgcgatcttgttacagtctctgaaaatgtttttatctacagcttcatcttcaacacttatttcctctttcactgctgcttccatggcttctctgtcactccgaccagctcccagctctcaggacaagggccctgggcgatcttttaaaaaagccgattgggtgtctttctaaaattacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtcctagagggtaaaaatcaagagcgttaagaacctggaaatgccgagacggcctccctgactgggacgaagcatctgcagatctatctcagtggcggggtcacgccacagattttgaaaactgaccctctctgtctccgttttcggttaagggtgggaagtgccggccgggtctttgctggaggctaggtctccagccagattgtactgcagcatcgtactcttcagggctagaaggggcctttgaaggttgttacactacccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagactaggaggattggttggtcttttcttggatttgattatggaaagctacctgatgcatctggttgctggaggctgactacttttagatgtgctgtaatctttccagggtcttggcttattgaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgattttaaaaaaagtttcctaggaagtatctctgaggaacagcaatctgaagaactgactatattctcatgctaagtcattagccaaaagctggtggtattgttgcatgctgctattgcatattaaaacgtagcagatgaataatagttgtaatgcagcaggatagttggtcaaattatttttttagg

SEQ ID NO: 737387 - DNA, 1497 bp, Homo sapiens
atggataaaccaaatgtggcatatgcacaccatggaacattactccacctgctgtggagttcacgttgctgtgaacactggtatacaaatatctgagtggaattgctggatcatatggtaattctgcatttaactttttaaggaactgccaaactgttttccacagagctgtaacattttacatccaaaccagcaataggacctggataaaaggtggctaaggcacagttaaataaaatactgttagttactgcccatttgcattgggtttctagtggcaaataatctagccgtgtccttgactggatctcccaatgattcttttcagtcatttgaatgagtatggtggtggtgacactggcaggaggctggagggtactttaattaacacgcgaacacacacaaatccattgcaccccactaagccgcccaaacacacatgaaacacaaaaactatccttgctagggaaacacagccctggaacaaaccccctggaccccttgtcaccaccagcccatcctgtaagaaaatgatggttgaagctgcagtgacagaattggagagatgctctgttagacaagtctgtcagctgaaaggggcagaaaccattgttgaactgcttatatgagaggaagacctgggtggcacaggcctggctggacgcagggctcacagagcgtcatcagcacttcatctcttcccctgcgggacctgctgtcctctgcgttgcacacaccccccgccaggctcatccctgtatcctccttggaggaaagtgccaggctggtgctacttggccctgcctgggtcacacgcctgcctcgggatgtggaggatggtcagcccagccacagcacatggattgctatgtgaaggatgatgttccacaagaaaaccaggacggcttcaccagggaggcaagagcagcagatgcccatgacagagggtgtatactctgaataaaagaatttggatttttaaaaagagacaggaagaaaaggacttccaaactctagaaagtttaaaactagtagaatgaaacatattgtgtataaatgtaaagctctttgttgagattaaatatacgtatcagttaaattttatttaaacatatatatacacatatacacacacacacatacatatatatgacccaagtacaggataaagatgaaattaataagtactctttaaaaatcttagttttggggctgggcgcggtggctcacgcctctaatccaagcactttgggaggccaaggcgggcggatcacctgagatcggtagttcgagaccagcctgaccaacgtggagaaaccctgtctctactaaaaatacaaagaattagccggacgtggtggcgcatgcctgtaatcccagctactcgggaggctgaggcaggagaatcgcttgaacccgggaggcggagatcgcagtgagccaagatggtgccatgtcactccagcctaggcaacaagagcaaaactccatctcaaa

SEQ ID NO: 737388 - DNA, 1529 bp, Homo sapiens; identical to SEQ ID NO: 62682

SEQ ID NO: 737389 - DNA, 539 bp, Homo sapiens
agatttcaccgccaggcttcttattgctaaatccttcttaggaccttaaggtagcctcctctccaggcttgttctccctcttggaatatggggaggactggaggacctctaaggtcccttggttctccccagtccttagattaaaaggcccaggccccaggctggccccctgcctgctgtcccactccttcattccatttcttggaatgtggccatgcctccagtgcctccattcaaccccctctaactgattccttccatcctctgcgaccagagacgccgcccgcctcctgcccaccacctccagaagctcctggctggggtgcactgccgtctcctcccactccccacattgccatgcctgggccacgcccaccccacccactcacccacccccagtgtccgttgtgtgacctagtgcaccatgtattagcttccatggcccccaccccagcccccaccacaccccctttccccacccctttcccctcggcgacttcacctttttttgccgcgataaacgccatctcagcatctgt

SEQ ID NO: 737390 - DNA, 1106 bp, Homo sapiens; identical to SEQ ID NO: 60469

SEQ ID NO: 737391 - DNA, 489 bp, Homo sapiens
aaatttcgtaccttctataattggcattcttcaaagaggtagaactttgatttttttgtagaatattaaaacaagctttcttaggttaaagaagtgatcttactacgaacagcaatggtttcatgatgtgtaattgctttatgttatctttctgctatagaatgtttcctggagaaaggtacggtttttagtaataagataaatttactttagtcctgcaaataaggtgaaatcttatgtccagtatctcacaaaggagaactgacagtgccacttttatatttaatgtcaatctcattagacaaaaatgaaatatagttcctagggtttccaatttaaaaagtgaaataataaatatattcactcaaacattttctcagtgccatatgcaagttaccatgtcccagaagctgatacagtttgaagaaggaaatatataagtactgtaagcctgtgataactaaaagcaacatactaaaaagtgaaggt

SEQ ID NO: 737392 - DNA, 1037 bp, Homo sapiens
cagcacatggcacaatgcccagcacatagtgttttgagagacagctgactggctgtctcatacaaggccctgctctgttgggcacaagggctgcttaacacattcctatgctacaaaagacagtgctcctctccaggaaccaccaaataaattcagatactaatgccaaaaagaaggcagcatcagcttgggaaaagagtgcctttaaggcactgtttctctctatgaaggcagtgtggaatgatagggatgatctaggacctagaggagagaccttaagtcttacttgcagccaaaagccttcaaacctgagctagccagaactgttacatcagaattctcacccatgacaagaagcctggagggagtccagggttgatggattgacttaaggtgtcatcaaaagcttagactttacccttctgctgcaccacccttattgccttgttgtcacaagaggactactgctgttcaagtcatcacttccacattccagaaggaagaaaggagaggtagagggccagaagtatcccctccttttatcaggagccattaactttcccagaaacttccatgtccacccagcagacctccacttacatctcactaggcagaactcctatcacttggccaccccagcagtcagggaagctggaagggtgagcattcagctatagagagtggaagcacaagcagcaagggaagaacaggtcagtaattgctgtagagtttcctgcccagcagcatctgccaaaactaggtaaattattttttaacataatagtatttttgtggattttcttacaaaagcaatgcatatatattgttactttgaaaaataaagattttaaatcttcaacaagcccattactcaggagtgatgactgttattcttggtttattagctttctagatctttgtattttttttaacgtgggtagaaccacaatatgggttgctctgaaattagcctttacacttggcattgtgaaaaatctttccaaatcattaaatgttctctgcagaattaaaaatta

SEQ ID NO: 737393 - DNA, 727 bp, Homo sapiens
gaaaactagtaaaaggacactttaagcatttattttacctttcctgtataaacaatatcactaggtaaccaagtagacaatgaaggcaagggtctttttatacaagtattcaactaactaaaaagataatttgttgaattagaatttcagcagtttacaatgaattaacagacacagcatcacatatcaacagatggtaaccatgaaaaggacaaaacaagaatacgtgtctccgatagtcttgctaaacaccagcagtcttttcaaggagatcaaacctgagtctgatcaagtctttgggtctacttaccaattggcaggaaacccagaggacagaggaacatgctgcaccatgtgtatgcagtcaacaagttcagttcaaatatatcttggatccttcagcaaataatgtataaggaacataaaaggtagagagaaaaatctatggataaaaagagacttaaaagaaatgtcaaagtttaaaaataatacaatcctaattatatttggtaaacatggatgttagagctgtttttaaaagctggaatgtcattactataaaagtcaggagtgattacctgtgtgggaagggaaggggctgtgatgggactgatgccttggtggttttagatggttggtaaagttttatttcttaacctggtagtggttctgaggctttttgacttagtataactcattaaaccacacatttattttgcatgatttt

SEQ ID NO: 737394 - DNA, 1669 bp, Homo sapiens
atcgcttgaacccaagaggtggaggctgcagtgagccaagattgagccatggcactccagcctggggacaagagagacttcgtctcaaaaaaaaaaaaaaacaaaaaaacatactttttgaaaattagtggtctgtaattgtaatcttgcagtagttgtttattgaatactagcataagtaaggattgaatgggatagtaaaggttgtctttgcccttgaggaactcaggctcattgaggggggtaccgttccttgaatgtttcctttttttctgcagcaaatacacacattcaaaacatctactgcacacaagcaaactcagagaggaccagcctggctgagaggagttgaccatccccctcaggactgacttcctttccttcaacattattatataattaaagtcctagactatatagaagtgacaggtatgctctctatgcatttattattatgggaggtgttttacttggaagcagtactttctccatgttaagtgctttgagctctgaagggccatcttaatccattctctctgacctcagaggttgtcaagacctatagaagagtttctatcaagccacattaggaaaaatgtggatgtctactttttggcttcactttttttaggatttgtatttaaggtaatttctttgagaacaggtaaaaggaaatggttcaattaaaaaggaaagggtcatttaagtaagttactaatttttgtgaacacctatatgtcttagatatgacctgatgggcagagaaggcatactagctttaaattaggattaaatcccggttttacaattaccatgtattgcatttcccaaaataaactactctgaatcttggtttccttatccataatgtagggatgataaaacttgcagtataagctaatgttttaggatgcatttggagactgcattataaggttacagagaagataacaacagaaacatttgagagcttactttgcgcctgacactgtgctaagagatttcaagtattaatatagttataatatagaggttagacagcaagcatcatgtctagcatataatatgcaatcaattaaaatttccatttgtcttcctctcaattttaatttctcatttaatttacattcagacaaatagtcatctagcttcatggttctcaaacctggctgatcattatatatagctttgagctttcaaaaaatactgatgccaagactctaccctgaaccaattaaattacagcctaaagtgcagctgagtttgagaatcatggcttaccttttcttgaactccttaagttagggaatacatactcccttcccagttttgtcaaattgattcaaatttgccaccttataaacatccagctattgcaaagagcctggtatatcgtagagtttcagtatatctatttcatagtttcccccctgtggtcttgcagaatggaattaacctgaattcaacaaaagaggtctttaaaattcataacagcaggtgtcgtctgtctttgaaattcccttgccaaaaaaggaaatgatttcttagtgatatgctttacttctgttgatcactatttgctcttttaaagtgtccaaagatgttttaatagatacttggtatttgttgttttctttaataaagtataatttacatgtagcacaggaat

SEQ ID NO: 737395 - DNA, 672 bp, Homo sapiens; identical to SEQ ID NO: 23665

SEQ ID NO: 737396 - DNA, 2799 bp, Homo sapiens
attggcgggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaaggaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaaggtaaagtggctgtaggaccagttaatgactgtaactgaggcccttagtttttcacgcagaaaaaaaaaatccattataaaaaaagagaattcacacagaatcccaaatctagatctaatttaatagtttttccaagagaagagaagaaactgatacccagtgtaaacacttagaaaatacaaaaataaaaacgagaactatccatagtcctgggagaggcactgcaaacattttcaaacattttaaacttaccaatatgtatattaacttgttaaaaatcattttaacatacaagtttatatttcatttttgcttaaagttataacatagctattttcctgtgaataatgtaagcttttcataaatattgactcttaacggatatgatgctgtaacacgagactgtgccataatta

SEQ ID NO: 737397 - DNA, 4683 bp, Homo sapiens
attggcgggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaaggaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataatcctagtcctgtacttctttaccttgatgctctaggacatctgatgataaagacaaggttttgtcttagattatcctaataggcagattgagttgtcggctgattcagtgagccaagctctagttagtgcagactccttccatcagttcagcatgaccaa

SEQ ID NO: 737398 - DNA, 4628 bp, Homo sapiens
attggcgggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaaggaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtatgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataatcctagtcctgtacttctttaccttgatgctctaggacatctgatgataaagacaaggttttgtcttagattatcctaataggcagattgagttgtcggctgattcagtgagccaagctctagttagtgcagactccttccatcagttcagcatgaccaa

SEQ ID NO: 737399 - DNA, 4311 bp, Homo sapiens
attggcgggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaagtttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataatcctagtcctgtacttctttaccttgatgctctaggacatctgatgataaagacaaggttttgtcttagattatcctaataggcagattgagttgtcggctgattcagtgagccaagctctagttagtgcagactccttccatcagttcagcatgaccaa

SEQ ID NO: 737400 - DNA, 4565 bp, Homo sapiens
ctctcagtgaaagttcctcactgagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataatcctagtcctgtacttctttaccttgatgctctaggacatctgatgataaagacaaggttttgtcttagattatcctaataggcagattgagttgtcggctgattcagtgagccaagctctagttagtgcagactccttccatcagttcagcatgaccaa

SEQ ID NO: 737401 - DNA, 2984 bp, Homo sapiens
gcagacttcgaagctcaaagcttttccttttccttagaccccaggttaatgtataaatgttcccttatttctactttctcatctaccatctactttattgcaaaaaaatagttctgttttgttcaccagaaggctgaaaaggaagactcttgtgaactgtttctgtggtttctgaataaagtagagaacttggattaactaagccctttccctgtgctataagctttaaccgaccttatctcagtcaatcagcccaacagcttgtgaagcaggggatgagtttcatagagagaaactggggcttacagaattcagtgtcttagtccagtgtccagcctggaagtggagaggctgggaggggtcccagttctgcactctggagcctgagtctttcactcttgtgggcagcgcaagaatcatgcagtgtcaaatggtgcacctccctctcctctccctgtctctgtctctgtctgtctgtctctttctcttcctttttagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataatcctagtcctgtacttctttaccttgatgctctaggacatctgatgataaagacaaggttttgtcttagattatcctaataggcagattgagttgtcggctgattcagtgagccaagctctagttagtgcagactccttccatcagttcagcatgaccaa

SEQ ID NO: 737402 - DNA, 2262 bp, Homo sapiens
cctgtccttacccacttttccaaacggggaagactcaggtatcaggaattacccattgcacattttgcgggggggggggctaatgtagacatgacaccaagtgcttttcattttaattctctaagcagtagatgagatctttcccttgggagaaatcacagagatggagttttccatttctgcttatacgaaatatgactgaaaatgaacaaagccacctttttaaccaaatacactagaacatatgcactcaagagttagcataattggagttattttcttgatgttgcatgtgccaagaacacttagggttcccctttgggattacctttgaagccatgcaaggcaagaggcctcacaactttatagtcagaccttgtgttttatccaacccctcctcctgcccaccaagatcatcctgagctgcttcacccattttatttagcagacttattttctaatgctctttagctgttaaaaaaaaaaaatcattcctcaaaaaatagatctacccttaaaggacaaagatttaccaacactgaagacccttacaagttgacagtttctaaagagggttctaggaatgttctgtgtaaggtcagcttcactggaataaacatacatcttcccaaggtgactacttcaaaggcaacactacccattcgggtgcagaaattaccgtacttactctgccataaatgtaaaatgtgtataaagttaagctattgcattttttcataacacatttaaatagaaattggcttttaaagtattgtagttaaaaccagatctcaccaagtaatagttgtgcaattgacaaatgtttggtgccatgtaatggagatgtcacactacacagttgtagtttaaatgcagtccaacataaggtgcatgccactgaactgtaaccctagtaatgtgtcttgtacagttgaaaaataatacttcacctttatataggttaagatatgtaccttatctttaccactcagggtggctttaaaagacggacagctttaggtttgttctcactggaactggttacactttctgtgcaaacttaaccaagtgatgatcgtctggaagctgcattccctcatttccactgtttggtgtgaatctagtctccccactttatctaaaaggaggctagcagggccccagcctgagcagagcagctagagagtgcttccagattcctttgccaaaggaggcccattttccagctgtgagtgacatctgtagtcattggcttcattgcctggcactagccctgtctagaagtggagaaagctggatcacagctggaccacaaccagccccaatccaggatttcccataccatgctggctgtgggctctgtgagcctcagccaggtggccaggctatacttgtcacagctggccacaggcctgctgaaggaacatggggtgtagagccagagcctggttctggttctccgcttgaacagctgacctcgtgcaatcacaggaactctgcgtctccatgtttcactcagatagagaaaatgcctcctttgtttacctctttgaagctgaagtaagtgagactggtgcatgtaaattaatggtagtagagcacctcccacatctgattttataacagtttcccatcactccttaaagaaaaaggccaggccgggcgtggtggttcacgcctgtaatctcagcacttcgggaggccgaggcgggtggatcatgaggtcaggagattgagaccattctggctaacacagtgaacaaaaaattagtcgggcatggtggcgggcgcctgtagtcccagctacttgggaggctgaggcaggagaattgcttgaaccttggaggtggaggctgcagtgagccaagattatgccactgcactccagcctgggtgacagagcgagactccgtctcaaaaaaaaaaaaaaaaagccacacattcttggcattagcacaccaaacagtggtagggtaccctgagaaaggaatgcagcttctcagaggcctcacttccagccagggaaacttaagacctgaaaggaataaggctctttgtgtattcagacagccttctggatgtatcgtatataacctgaaactctccactcttgtataccaactaacaaagtcttccttatgtaacatagattgcagtgtctgtatatggtcttcccattatctggtagtagcatcttgaaactggtcaaaacttgaatgccaatagctcagtcactcagaatatacgattctgcacttggga

SEQ ID NO: 737403 - DNA, 520 bp, Homo sapiens
gtctacactcagagtctgcagtctaccaactttaatgaaatgtaattttatgcataacataaagtaatattaaaaattacttgtagaaatagttaattgggctaattagatattctttttttttttttctttgagatggagtccagcctgggtgacagagcgagactccgtctcaaaaaaaaaaaaaaaaagccacacattcttggcattagcacaccaaacagtggtagggtaccctgagaaaggaatgcagcttctcagaggcctcacttccagccagggaaacttaagacctgaaaggaataaggctctttgtgtattcagacagccttctggatgtatcgtatataacctgaaactctccactcttgtataccaactaacaaagtcttccttatgtaacatagattgcagtgtctgtatatggtcttcccattatctggtagtagcatcttgaaactggtcaaaacttgaatgccaatagctcagtcactcagaatatacgattctgcacttggga

SEQ ID NO: 737404 - DNA, 1607 bp, Homo sapiens
accgcgcccgcgccacgccctcaccacctcccctagatccagaggggaccggtccggaatttttccaatgagggcatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacgcttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaaaaaag

SEQ ID NO: 737405 - DNA, 1913 bp, Homo sapiens
gggtaggtacgaggctgggtggtgctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacgcttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaaaaaag

SEQ ID NO: 737406 - DNA, 2473 bp, Homo sapiens
gcttctctttaaaattgacccaaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacgcttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaaaaaag

SEQ ID NO: 737407 - DNA, 3281 bp, Homo sapiens
tgtgtgtgtccaggagtgtgtgtctaggtgtgtgtgtctaggtgtgctcgttgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctcccgggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacgcttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaaaaaag

SEQ ID NO: 737408 - DNA, 736 bp, Homo sapiens
gtgagtgagcctcacaggagtcagcacactgtagcctgtgcccaaatctagcccacagcctgtttctgtgaagccctcaagttaagaaatgctttttatagctgagcatggtagctcacacctgtaatcccaaagtgctgggattacaggcatgagccaccgcaccaagcccaggtagtattttcaacaaattcttcttaaaatgtcacctagaatgccatcatcaaatccagcaactatttttatttctttatttcctgtgtccaatcgttggctctgttttgatgtcagcatttatagttttgctctgtgtctcatggtagaaatcttcctcgttaagtcattgatcccgtccttccgaagggatcttggctctctgtggtgaaaatccttcaaaccctgtcctgctttggtccaaggtcattccacttctaggaatctttcctgaaggatctaccagcaatgggaacaacagctgcagcttaagtggttgcatcatggcatcatttctaatgtcagaaaactggaaataacacgaagggctgacatggggaggactggtcagataaattcagggcacagctgtccaccggcctggcagaaccttgaaatcacatcattaaaagcctatttaatgatgagagaaattgctcaacggaggctaaaaacaggatacataaaactgtatactcacagttttttaaagtatgtctgcatgactgtacatgcaaagaaa

SEQ ID NO: 737409 - DNA, 4516 bp, Homo sapiens
aatttttcgaatatcgtcgaccacgcgtccgttatcctagaggttgggtgaccaaccctgtcccagtttgcctgggacttgagggtttttccaggatgcagcactttcagtgctaaaactaggaatgttccaggcactctgggatgagttggtcaccttgcctaggtgcctaagaacctctcccctgcccacgtactaagaccaatgagtaagagagacaaggctgggaaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctcccgggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacgcttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaaaaaag

SEQ ID NO: 737410 - DNA, 4873 bp, Homo sapiens
ccgcaacaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagctgcagtccatggtggatctcctggagggcaccctgtacagcatggacttgatgaaggtgcacgcctacgtccacaaggtggcctcccagatgaacacactggaagagagcatcaaggccaacctgagccgggagaatgaggtggtgaaggacagcgtgcgccacctcagtgagcagttgaggcactatgagaatcactctgccatcatgctgggcatcaagaaggagctgtcccgcctgggcctccagctgctgcagaaggatgccgccgccgcccctgccacccctgccacgggcactggtagcaaggcccaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctcccgggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacgcttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaaaaaag

SEQ ID NO: 737411 - DNA, 382 bp, Homo sapiens; identical to SEQ ID NO: 26428

SEQ ID NO: 737412 - DNA, 1893 bp, Homo sapiens
  misc_feature (274)..(274): n is a, c, g, or t
gaggggtgggacccgcggcggaagcacatgcccatggggctggtgtttgctgaagctggagccaaggtggccacccatcctcagctcaggactcagcccccgaggcctcctggtccagggccccgggaggtgggcatggggctggcctgaagccccagggatctcaccggctgtcctgtttcctccagctgtgaggcatcagcctgggcaggccggagggggctgggatgagctggacagcggccccagctctcagaattcctcccagaacagngacctgagcagggtctcggactcgggcagtcattccggcagcgacagccattcaggggccagccgggagccgggtgacctggcagaaagctcttccaggaagccctccctgactgcacatgcagtttgccacccatgacacagctcatgctcaactcccaagctccggagggcagaaatggttccattcatctctgtgcacttgaacactctgaactgcctggcggccactggaatcacacggggaggcctctcccggccgccaggccctggcaccttccctctgcctgtgggcattcccagcttctttcttcctgttttctccctggctttcagtcagagcgacgagtgagcctggggttcgcaccaccgcaggcgaacctcatagtggggtttctaaaacgggcatgctggaagaaccctgcgtccaacagttggaaatgcccagatgtgccaggccacgtgttcactccctccggcagtgcctggcgggttatgacggggagggtgtccatttgtctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgcgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 737413 - DNA, 991 bp, Homo sapiens; identical to SEQ ID NO: 285126
  misc_feature (673)..(673): n is a, c, g, or t
  misc_feature (682)..(682): n is a, c, g, or t
  misc_feature (701)..(701): n is a, c, g, or t
  misc_feature (704)..(704): n is a, c, g, or t
  misc_feature (711)..(713): n is a, c, g, or t
  misc_feature (719)..(719): n is a, c, g, or t
  misc_feature (728)..(728): n is a, c, g, or t
  misc_feature (732)..(732): n is a, c, g, or t
  misc_feature (735)..(735): n is a, c, g, or t
  misc_feature (747)..(747): n is a, c, g, or t
  misc_feature (751)..(751): n is a, c, g, or t
  misc_feature (755)..(755): n is a, c, g, or t
  misc_feature (759)..(759): n is a, c, g, or t
  misc_feature (769)..(770): n is a, c, g, or t
  misc_feature (776)..(777): n is a, c, g, or t
  misc_feature (781)..(782): n is a, c, g, or t
  misc_feature (790)..(790): n is a, c, g, or t
  misc_feature (803)..(803): n is a, c, g, or t
  misc_feature (811)..(811): n is a, c, g, or t
  misc_feature (818)..(818): n is a, c, g, or t
  misc_feature (822)..(822): n is a, c, g, or t
  misc_feature (831)..(831): n is a, c, g, or t

SEQ ID NO: 737414 - DNA, 4315 bp, Homo sapiens
  misc_feature (2698)..(2698): n is a, c, g, or t
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccagggcgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctagtatccttccttgatgtccccgtgtagtggaaagagcggatggcagggtcccagagtggtgcaaagggttcctggggattctgctgtccctagggggatgcacggctcctttattattgtaaccaggcatgggtggggtctgaaggctgcaatactgatgacacaggggaccctagaagcccaggtgctcctgatggcagagcctccagtaggcgcctccagggagcgtgaactgagaggccccatggcctggtctccctgcggcctggcgcagccctcatcatctcgcccttccctaacccgagcgtgccgcagaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagngacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgcgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 737415 - DNA, 2101 bp, Homo sapiens
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccagggcgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgagcccctgggtggtcaagggtcaggcctgaggcccggcccacggtggtgaggatggaggagcagacgagcggcccagggtggcaggcagctctgtgcccttggggtgcccccgggccctgccctgggtgtcccgtgtccggcctgcccagcactgctgaccgccccactccccaggtgctgaagatcctgctctatctgtgcagccacggctcctccttcttcctgctcatcctcaaacgcaactctgccttcatccaggaagctgcaggtacaggggccgcgcacgcgctcaggaagagccagggctttggagaatg

SEQ ID NO: 737416 - DNA, 4000 bp, Homo sapiens
  misc_feature (2383)..(2383): n is a, c, g, or t
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccagggcgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagngacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgcgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 737417 - DNA, 1794 bp, Homo sapiens
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccagggcgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctaaaatctcccacgagtctccgggcagcagccagtgcctgctggagtacctcctgagccgtggctgcacagatagagcaggatcttcagcaccttgagcttccgtcga

SEQ ID NO: 737418 - DNA, 3909 bp, Homo sapiens
  misc_feature (2292)..(2292): n is a, c, g, or t
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccagggcgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagngacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgcgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 737419 - DNA, 729 bp, Homo sapiens
gggatgtttaggggaatccttggcttctacccacaagatgccagcattcaatgctgatagctgcccctcccccagttgtgacagtcaaaaatgtctccagacatggccaggtgtacctagaggccaaaattgtccctggttgagacccactgatgaatgtgtgcaatagtggttcccataaactgcatttaaaaaacagctgttaggtttcgtttggctcaagggctgtcatttttcactcctccccccatagagtatgtaaaatgattagaaatgacaacagactatcatttagtatcagattagtgtgtgtatatgccataaattatttccttagcaattcctttagtatttttgttgcaataattctttaaacgctacatttgtaatgctgtcttggagcctaggaattatttttggagatatttatgcagacttccctctataatgatcggttttttattatggttaatccataaatattttgagatgtatctctaaaaaacgagcactctttgaaaacataaccacaatgccattattatacctacaaaaattaaccacaattccttaaaacataatgatgcctttttgaagagagatatattgagacttcattctggggagaaacctttcagataactttatttaccttttcctttgccaagcatacaacattagatttgaaatatgctttgtatcaagtggaagtgtctcttaagatagccc

SEQ ID NO: 737420 - DNA, 10453 bp, Homo sapiens; identical to SEQ ID NO: 4

SEQ ID NO: 737421 - DNA, 10618 bp, Homo sapiens; identical to SEQ ID NO: 24
  misc_feature (9466)..(9466): n is a, c, g, or t

SEQ ID NO: 737422 - DNA, 10512 bp, Homo sapiens; identical to SEQ ID NO: 25

SEQ ID NO: 737423 - DNA, 2399 bp, Homo sapiens; identical to SEQ ID NO: 26

SEQ ID NO: 737424 - DNA, 2490 bp, Homo sapiens; identical to SEQ ID NO: 27

SEQ ID NO: 737425 - DNA, 2995 bp, Homo sapiens; identical to SEQ ID NO: 28

SEQ ID NO: 737426 - DNA, 2995 bp, Homo sapiens; identical to SEQ ID NO: 28

SEQ ID NO: 737427 - DNA, 2455 bp, Homo sapiens
ccggtggggtgcagccctgctgaagccccagagctcagcccagtgctgggcacatagtaggcgctcaggaaatgattgctgaatgtggaatgaaagtccccagcagacaaaaggctgtgacttctgttagtggggtggtggtcctctggggcgagtgtatggagaacttcaaggcctcctcctggctgcccaggaaagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagtta

SEQ ID NO: 737428 - DNA, 2124 bp, Homo sapiens
atggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggagaacctgcgggcaggctttcatcgtccgcggagctacaggcttccagcggcctggggcctcgtgggtactgagctgcgtgtgggggtccaggacccgatgtcgcctgccattcggccagggcatcggcagatgtattggtccagcccccgagagacccaggaagaaggcaaggaggttcggtacgagccatctcgaatggaagaagaaggcggtcgatatacccgatctgcctttgcggacccagctgtcaagggctgcaccgtgcctggatatgagctgtatttgccgagatgtagcatgaaggagaatgggtctgttgttgaaatccaaaatttattgggtgaaaaatacatccacggggttcagatgagaccaggtgttgcttgttcagtatctcaagcccaaaaagatgaattcatccttgaaggaaatgacattgagcttgtttcaaattcagcggctttgattcagcaagccacaacagttaaaaacaaggatatcaggaaatttttgaacgtctcctcctacttccgtaaaaagcctttagtttcagaaccaaggcagcagccagttctccccagtaaattaccagacccaaagagagagtttcagaaccggcagtcgaagagcttcctggcagaggtcccgggcctggaaacactcggctttctgagcgaggagcaccctctagtgtctgtccacggggaacgcaggagcgtgagccccttcgcgcccccagcgccgtcggcgtcgctgccccagacacagacactgcctcgagaggcctcacagaggcgggggcagaaggcggcgacccagagccgccacatcccccgccttgggcgccgtcacagtccccagacgccctggactcctgcagtctacgaagacgcgcgggggacggcgtggttccgagaggcaaatatggaggaggtagtgattgggtgttgtggcctgactggtctcagtctaagagtccccagcacctgtgacctggttcctggtgttccaagaagtccagtgtcttcttttgcaagctgggggaggggtttaaagatgctggcgctgccctctagccggctgctggggacatcaaaggagattcgggctgtggaaggctccctagcgtcggagatggagttaggagagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctag

SEQ ID NO: 737429 - DNA, 600 bp, Homo sapiens; identical to SEQ ID NO: 32

SEQ ID NO: 737430 - DNA, 4128 bp, Homo sapiens; identical to SEQ ID NO: 12

SEQ ID NO: 737431 - DNA, 3753 bp, Homo sapiens; identical to SEQ ID NO: 29
  misc_feature (1005)..(1005): n is a, c, g, or t

SEQ ID NO: 737432 - DNA, 3260 bp, Homo sapiens; identical to SEQ ID NO: 30
  misc_feature (1005)..(1005): n is a, c, g, or t

SEQ ID NO: 737433 - DNA, 2932 bp, Homo sapiens; identical to SEQ ID NO: 31

SEQ ID NO: 737434 - DNA, 600 bp, Homo sapiens; identical to SEQ ID NO: 15

SEQ ID NO: 737435 - DNA, 527 bp, Homo sapiens; identical to SEQ ID NO: 18

SEQ ID NO: 737436 - DNA, 1417 bp, Homo sapiens; identical to SEQ ID NO: 21

SEQ ID NO: 737437 - protein, 161 aa, Homo sapiens
MTYFGHFGGANHAHTLGELEACIAMLVEQLRTQGCGGRTLGTSEEEAELQQKVEENEHLRLELQMVETERVRLSLLEEKLVDVLQLLQRLRDLNISKRALGKILLSTLDAFRDPTHEGRPSPAAILDALHQALAACQLLRRQPSAPASAAAALTNPLLVSC

SEQ ID NO: 737438 - protein, 78 aa, Homo sapiens
WAGRLTWCGASLGLSPAYGLSRVFKPSGFLLVKMSDKPDLSEVEKFDRSKLKKTNTEEKNTLPSKETIQQEKECVQTS

SEQ ID NO: 737439 - protein, 86 aa, Homo sapiens
WAGRLTWCGASLGLSPAYGLSRVFKPSGFLLVKMSDKPDLSEVEKFDRSKLKKTNTEEKNTLPSKETRLCLKKRKSFLSLNLEPSY

SEQ ID NO: 737440 - protein, 107 aa, Homo sapiens
VADPSAPASGPGLSFLAGLSLTTRHPPYLKLVISFLFISAAVQVEQSYLVLFCTHASQLHDHVQGLEVSAVLSTPLWEWVLQRFGKKTSAFGIFAMVPFAILLAAVP

SEQ ID NO: 737441 - protein, 137 aa, Homo sapiens
ASQKMGQKISRQPYSGSWSLFSCSDPQKASKSLNLETRQFFLISCLKAVQSSVNKPLHAGLINAGPLRAMTQEHGLGSTLKSRNHSTDNGNFVGGNRLLELNAFVRFLDLQISLCGPALGGKAGIHNNLINLTQTTC

SEQ ID NO: 737442 - protein, 120 aa, Homo sapiens [sequence omitted]

SEQ ID NO: 737443 - protein, 111 aa, Homo sapiens
LFFFDGVSLLLPGLECNAAISAHCNLRLLGSRNSPASASRVAGITGMYHHAWLIFVFLVEKGFCHAGQAGLELLTSSVPRISASQSAGITSMSHRTRPILLNVGNSLKICL

SEQ ID NO: 737444 - protein, 114 aa, Homo sapiens
QKSPFLNYIHSEVIWSSPTPGLLRKNNTAVPKRQLTNSPSSFFYTPLPPLETNFGDKAIATVMRKELSSPVSVVRLVQMSEMATISCKELWITVVKCPGVAVSLVTEWKKELAV

SEQ ID NO: 737445 - protein, 142 aa, Homo sapiens
SLPFHSFAAVFSPNSSSSPLLFPLHLLLHLPPQSFPLSQIWSFSANLGRGCRSDVIISSLCITRGRSKARRWCHKSPREEGTLSSTLLGSAFLVFFRLSGPGLDWKFPGVSFAIAQFHRCPQPGFPTLSAGNHTLPFARLPA

SEQ ID NO: 737446 - protein, 124 aa, Homo sapiens
MGHGDNRGHLWLSPCRSGASEHGINCILSSPAPCQQPSSHTQRTDTGKGRVAELLVSWGQRRKPSTLYTPRPGPWHRGAAWGLRSHTAELEPSLSQCQLCTLSSDGTAAWPGAAGTLTHSSGHS

SEQ ID NO: 737447 - protein, 684 aa, Homo sapiens
WGPGSTDEAFTYLGKSGGAQKEKKTVGGRGSSLCLHLCPLKQKGISFLSSAPNPVEARLGTLFTSPRFPSRSPLCHPCTLFRVMPERELWPAGTGSEPVTRVGSCDSMMSSTSTRSGSSDSSYDFLSTEEKECLLFLEETIGSLDTEADSGLSTDESEPATTPRGFRALPITQPTPRGGPEETITQQGRTPRTVTESSSSHPPEPQGLGLRSGSYSLPRNIHIARSQNFRKSTTQASSHNPGEPGRLAPEPEKEQVSQSSQPRQAPASPQEAALDLDVVLIPPPEAFRDTQPEQCREASLPEGPGQQGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPIPIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPNEHRREALKKLGLLKE

SEQ ID NO: 737448 - protein, 727 aa, Homo sapiens
WGPGSTDEAFTYLGKSGGAQKEKKTVGGRGSSLCLHLCPLKQKGISFLSSAPNPVEARLGTLFTSPRFPSRSPLCHPCTLFRVMPERELWPAGTGSEPVTRVGSCDSMMSSTSTRSGSSDSSYDFLSTEEKECLLFLEETIGSLDTEADSGLSTDESEPATTPRGFRALPITQPTPRGGPEETITQQGRTPRTVTESSSSHPPEPQGLGLRSGSYSLPRNIHIARSQNFRKSTTQASSHNPGEPGRLAPEPEKEQVSQSSQPRQAPASPQEAALDLDVVLIPPPEAFRDTQPEQCREASLPEGPGQQGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPIPIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPHFILSPELRGGKGSQVEHVSLLVQPGQGLYWSQSLLLQQSQLLQGLPSVFIGDTLWGGL

SEQ ID NO: 737449 - protein, 538 aa, Homo sapiens
WGPGSTDEAFTYLGKSGGAQKEKKTVGGRGSSLCLHLCPLKQKGISFLSSAPNPVEARLGTLFTSPRFPSRSPLCHPCTLFRVMPERELWPAGTGSEPVTRVGSCDSMMSSTSTRSGSSDSSYDFLSTEEKECLLFLEETIGSLDTEADSGLSTDESEPATTPRGFRALPITQPTPRGGPEETITQQGRTPRTVTESSSSHPPEPQGLGLRSGSYSLPRNIHIARSQNFRKSTTQASSHNPGEPGRLAPEPEKEQVSQSSQPRQAPASPQEAALDLDVVLIPPPEAFRDTQPEQCREASLPEGPGQQGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASVWRDSQCWGSLWKLLRLLFRTILGGSFRGLGVVRGASRLFGSSPDERGASSALAF

SEQ ID NO: 737450 - protein, 417 aa, Homo sapiens
WGPGSTDEAFTYLGKSGGAQKEKKTVGGRGSSLCLHLCPLKQKGISFLSSAPNPVEARLGTLFTSPRFPSRSPLCHPCTLFRVMPERELWPAGTGSEPVTRVGSCDSMMSSTSTRSGSSDSSYDFLSTEEKECLLFLEETIGSLDTEADSGLSTDESEPATTPRGFRALPITQPTPRGGPEETITQQGRTPRTVTESSSSHPPEPQGLGLRSGSYSLPRNIHIARSQNFRKSTTQASSHNPGEPGRLAPEPEKEQVSQSSQPRQAPASPQEAALDLDVVLIPPPEAFRDTQPEQCREASLPEGPGQQGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAWAGAAG

SEQ ID NO: 737451 - protein, 128 aa, Homo sapiens
GVAGSPRTRSCCPFYLFTACVQGGQGFDGVELGADRVWMHCTAASLPRRQECQCLPSMGFFVLDSPWGPGMVPAYELRPLPRKSVLSGPRLVLVQWGLSLFSPIVRPLAVTCWSPLRHLLFGTDRGLF

SEQ ID NO: 737452 - protein, 126 aa, Homo sapiens
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 737453 - protein, 126 aa, Homo sapiens; identical to SEQ ID NO: 737452

SEQ ID NO: 737454 - protein, 126 aa, Homo sapiens; identical to SEQ ID NO: 737452

SEQ ID NO: 737455 - protein, 118 aa, Homo sapiens
MRRAGLGEGVPPGNYGNYGYANSGYSACEEENERLTESLRSKVTAIKSLSIEIGHEVKTQNKLLAEMDSQFDSTTGFLGKTMGKLKILSRGSQTKLLCYMMLFSLFVFFIIYWIIKLR

SEQ ID NO: 737456 - protein, 118 aa, Homo sapiens; identical to SEQ ID NO: 737455

SEQ ID NO: 737457 - protein, 83 aa, Homo sapiens
MRRAGLGEGVPPGNYGNYGYANSGYSACEEENERLTESLRSKVTAIKSLSIEIGHEVKTQNKLLAEMDSQFDSTTGFLGLCPM

SEQ ID NO: 737458 - protein, 118 aa, Homo sapiens; identical to SEQ ID NO: 737455

SEQ ID NO: 737459 - protein, 104 aa, Homo sapiens
QAKFLGVEYERHKREARACCVPTRARRCTSADKSWGSHPLPEHGGREMLRGRREPFWFSLPRPPMSWQGVLGKWEGEPQHTHPDGGDIIAFRPHGNGQPGLRLH

SEQ ID NO: 737460 - protein, 108 aa, Homo sapiens
QCQTETEALGSHSVCSKVAPRAGRKAPPAAKLLLHHPRCRGAAPGGGLQLPLSQGQACGVRAFSGPRPHCPSTGPACGSYADGSFLNAGAAVIFSHSTVIMESENDGA

SEQ ID NO: 737461 - protein, 72 aa, Homo sapiens
LCAMGPSGAFEATFWLLRHHRVILDKKFTLSEPRFFQLAMGMITPSSQGFAEGLLSHRGEELTVCPARSGWP

SEQ ID NO: 737462 - protein, 106 aa, Homo sapiens
FFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSER

SEQ ID NO: 737463 - protein, 267 aa, Homo sapiens
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPRHTSPTTCTLRKHKTNRKPRTPFTTSQLLALERKFRQKQYLSIAERAEFSSSLNLTETQVKIWFQNRRAKAKRLQEAELEKLKMAAKPMLPSSFSLPFPISSPLQAASIYGASYPFHRPVLPIPPVGLYATPVGYGMYHLS

SEQ ID NO: 737464 - protein, 267 aa, Homo sapiens; identical to SEQ ID NO: 737463

SEQ ID NO: 737465 - protein, 267 aa, Homo sapiens; identical to SEQ ID NO: 737463

SEQ ID NO: 737466 - protein, 194 aa, Homo sapiens
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPRHTSPTTCTLRKHKTNRKPRTPFTTSQLLALERKFRQKQYLSIAERAEFSSSLNLTETQVKIWFQNRR

SEQ ID NO: 737467 - protein, 267 aa, Homo sapiens; identical to SEQ ID NO: 737463

SEQ ID NO: 737468 - protein, 155 aa, Homo sapiens
VQPFLLAREEGAGPAFWVAEPGAFSQVLNFSERLKSGRAGPRPRSRPQPESFGIGSRELNSGDDAGGASSLFCPGRENAVRVRAEPEVWPEAGTSAVRMWYLIRDKAGVCVSVGPSWGHSGVWEEQTVGESTGQAVPVMSVEATRLQEPEQGDTG

SEQ ID NO: 737469 - protein, 108 aa, Homo sapiens
TLSQKQKQNKTKNMGDLTTPLLWLEQRRNTRRRRDRALQLSLPAWPHACSLNPPATAGCTFFSNEYGIFLKIDHMLAHQTGLDKFKGIEIILDMFSVKFKWKSTTKDS

SEQ ID NO: 737470 - protein, 76 aa, Homo sapiens
YITETSDTASVNRVKDAPLQKWLQAQHGSFPDTRRARTFAETPPTQVEEALAPLLSGWKGNTAGTPQSGKEAGPKP

SEQ ID NO: 737471 - protein, 83 aa, Homo sapiens
NQARKDDDVLHVAPGHAPGTETCPGGNTGTDVDGCPTGATLSREPCAAQGWALSPVSFLQASKYPGRDLTPEFQREERRTVKK

SEQ ID NO: 737472 - protein, 77 aa, Homo sapiens
MGQVWGLVHFTLDLFHTDDEEEREYSEVIEEVTEHVYLPAKAKVAKEGEVHPYPSAPPHYYFEEKDPPDLSFPEDTG

SEQ ID NO: 737473 - protein, 140 aa, Homo sapiens
MVDLLWKSSLAPLIPRVACLFHIPYQLYSIPALDSIGTSRSCTAQSWFVGPMAPRSLMAMHVRHSSLCSIVARQSKRRYIHTLEDHSTVKRNEITDTWHKMNEAQKRKKERWAQKPTYRPGAVAHTCDPRTLGGRGGRTA

SEQ ID NO: 737474 - protein, 153 aa, Homo sapiens
LLLSTAPTWSFPASALGLRKEFLAFEGGDLRHKPVKGTTPIHGEAPASLPYPGSAPIVTSSCARHLGFPVGVRGRGRAWLTLPWTLVPFGHRGVLLAAGSGGSAADPQPGPAPTEAATLCSVCFQQAPPPRASPLLCPKPVGLHHRGLGPGGL

SEQ ID NO: 737475 - protein, 75 aa, Homo sapiens
SVTHKHLVLGLRSLCFSFFAWKLPIPRTLQTASRNLPSTARDEQPQLLWASLLGSLISPEIPREPLRPTARVRGL

SEQ ID NO: 737476 - protein, 107 aa, Homo sapiens
FEGTIREVNATETTHRTAAGQASPLLKSPSLVSHSAHCSLLTKPHTNSKTSSLCFSGPSLDFRLILDRWGNDYLQSRIPYIATFPNSSVLLQYAQNWRGTFFSFPED

SEQ ID NO: 737477 - protein, 330 aa, Homo sapiens
RCGGRGRPGPAQLCPRPARPRPRPPDKPLSDPSSGFKSPGPARRTALLLTPARPVRPSVPLPRGPSKGPLHLGPKMTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQAAQRRSVSLCPVNGRTQANMFL

SEQ ID NO: 737478 - protein, 454 aa, Homo sapiens
RCGGRGRPGPAQLCPRPARPRPRPPDKPLSDPSSGFKSPGPARRTALLLTPARPVRPSVPLPRGPSKGPLHLGPKMTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 737479 - protein, 454 aa, Homo sapiens; identical to SEQ ID NO: 737478

SEQ ID NO: 737480 - protein, 33 aa, Homo sapiens
MGWSQVLAQPLGPATPTSVNLFTHLQIGDDMFL

SEQ ID NO: 737481 - protein, 123 aa, Homo sapiens
FFCYGHPSCMAPHLSHHRSRNTWGGSCCASFSILPPPHTIRIRISLHVASASVPFQAGATFPRSDAAASAPASDRPTRYHLSLRGIWEMRGRPAPRPPPLPTTCWDKVLAGCQNGWGWGQPWP

SEQ ID NO: 737482 - protein, 146 aa, Homo sapiens
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQYREEREIHATAYYKVDDPVWNFCG

SEQ ID NO: 737483 - protein, 102 aa, Homo sapiens
YHRVTPQCKIRYVYQQLCIFIEDHEFTHSLKKPIYVTREDKDLHRKIHRIIQQDCQKPNHMEKGCHFLHILACARLSIRPGLSEAVLQQVLELLEDHYYTAF

SEQ ID NO: 737484 - protein, 368 aa, Homo sapiens
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQKTKIEIGDTIRVRGSIRTYREEREIHATAYYKVDDPVWNIQIARMLELPTIYRKVYDQPFHSSALEKEEALSNPGALDLPSLTSLLSEKAKEFLMENRVQSFYQQELEMVESLLSLANQPVIHSACSDQVNFKKDTTSKAIHSIFKNAIQLLQEKGLVFQKDDGFDNLYYVTREDKDLHRKIHRIIQQDCQKPNHMEKGCHFLHILACARLSIRPGLSEAVLQQVLELLEDQSDIVSTMEHYYTAF

SEQ ID NO: 737485 - protein, 368 aa, Homo sapiens; identical to SEQ ID NO: 737484

SEQ ID NO: 737486 - protein, 368 aa, Homo sapiens; identical to SEQ ID NO: 737484

SEQ ID NO: 737487 - protein, 368 aa, Homo sapiens; identical to SEQ ID NO: 737484

SEQ ID NO: 737488 - protein, 359 aa, Homo sapiens
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQKTKIEIGDTIRVRGSIRTYREEREIHATAYYKVDDPVWNIQIARMLELPTIYRKVYDQPFHSSALEKEEALSNPGALDLPSLTSLLSEKAKEFLMENRVQSFYQQELEMVESLLSLANQPVIHSACSDQVNFKKDTTSKAIHSIFKNAIQLLQEKGLVFQKDDGFDNLYYVTREDKDLHRKIHRIIQQDCQKPNHMEKGCHFLHILACARLSIRPGLSEAVLQQVLELLEDHYYTAF

SEQ ID NO: 737489 - protein, 593 aa, Homo sapiens
GKEMKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 737490 - protein, 228 aa, Homo sapiens
GKEMKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTARMESDNGERTCGNRLGKCYAVVPSVER

SEQ ID NO: 737491 - protein, 242 aa, Homo sapiens
REGSGKMASLDRVKVLVLGDSGVGKSSLVHLLCQNQVLGNPSWTVGCSVDVRVHDYKEGTPEEKTYYIELWDVGGSVGSASSVKSTRAVFYNSVNGIIFVHDLTNKKSSQNLRRWSLEALNRDLVPTGVLVTNGDYDQEQFADNQIPLLVIGTKLDQIHETKRHEVLTRTAFLAEDFNPEEINLDCTNPRYLAAGSSNAVKLSRFFDKVIEKRYFLREGNQIPGFPDRKRFGAGTLKSLHYD

SEQ ID NO: 737492 - protein, 291 aa, Homo sapiens
MFEGSGMMASLESGEVPVLGDYRDNKSCDEEPSRNLKLREWFQDDQLGTAPVYSSQRERRRRQVISAFPTGVGKSSLVHLLCQNQVLGNPSWTVGCSVDVRVHDYKEGTPEEKTYYIELWDVGGSVGSASSVKSTRAVFYNSVNGIIFVHDLTNKKSSQNLRRWSLEALNRDLVPTGVLVTNGDYDQEQFADNQIPLLVIGTKLDQIHETKRHEVLTRTAFLAEDFNPEEINLDCTNPRYLAAGSSNAVKLSRFFDKVIEKRYFLREGNQIPGFPDRKRFGAGTLKSLHYD

SEQ ID NO: 737493 - protein, 242 aa, Homo sapiens; identical to SEQ ID NO: 737491

SEQ ID NO: 737494 - protein, 106 aa, Homo sapiens
REGSGKMASLDRVKVLVLGDSGVGKSSLVHLLCQNQVLGNPSWTVGCSVDVRVHDYKEGTPEEKTYYIELWDVGGSVGSASSTTNSPSSTTNSAAPRIRRAAPRIR

SEQ ID NO: 737495 - protein, 72 aa, Homo sapiens
MGVATTLQPPTTSKTLQKQHLEAVGAYQYVLTFLFMGPFFSLLVFVLLFTSLWPFSVFYLVWLYVDWDTPNQ

SEQ ID NO: 737496 - protein, 188 aa, Homo sapiens
MPAGCPPHSTTASLPQHGDRGFPFAAAAAAGQAPPRPRPAAAMQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDAKG

SEQ ID NO: 737497 - protein, 188 aa, Homo sapiens; identical to SEQ ID NO: 737496

SEQ ID NO: 737498 - protein, 188 aa, Homo sapiens; identical to SEQ ID NO: 737496

SEQ ID NO: 737499 - protein, 188 aa, Homo sapiens; identical to SEQ ID NO: 737496

SEQ ID NO: 737500 - protein, 188 aa, Homo sapiens; identical to SEQ ID NO: 737496

SEQ ID NO: 737501 - protein, 146 aa, Homo sapiens
MQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDAKG

SEQ ID NO: 737502 - protein, 168 aa, Homo sapiens
KNAEQLLRSLESLSSPKDDKDVMQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDAKG

SEQ ID NO: 737503 - protein, 150 aa, Homo sapiens
ILNEINPPPPFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDAKG

SEQ ID NO: 737504 - protein, 188 aa, Homo sapiens
MPAGCPPHSTTASLPQHGDRGFPFAAAAAAGQAPPRPRPAAAMQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDEPE

SEQ ID NO: 737505 - protein, 203 aa, Homo sapiens
MPAGCPPHSTTASLPQHGDRGFPFAAAAAAGQAPPRPRPAAAMQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDEFLFFLKDVFPVKRGFSL

SEQ ID NO: 737506 - protein, 203 aa, Homo sapiens; identical to SEQ ID NO: 737505

SEQ ID NO: 737507 - protein, 188 aa, Homo sapiens
MPAGCPPHSTTASLPQHGDRGFPFAAAAAAGQAPPRPRPAAAMQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDATS

SEQ ID NO: 737508 - protein, 150 aa, Homo sapiens
ILNEINPPPPFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEDATS

SEQ ID NO: 737509 - protein, 1556 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAETKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPRLQVHLEDPGYLEK

SEQ ID NO: 737510 - protein, 1556 aa, Homo sapiens; identical to SEQ ID NO: 737509

SEQ ID NO: 737511 - protein, 929 aa, Homo sapiens
MSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPRLQVHLEDPGYLEK

SEQ ID NO: 737512 - protein, 1556 aa, Homo sapiens; identical to SEQ ID NO: 737509

SEQ ID NO: 737513 - protein, 1558 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAETKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPTQAFKGGNPKKTPGGN

SEQ ID NO: 737514 - protein, 1346 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAETKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKLLRKSY

SEQ ID NO: 737515 - protein, 382 aa, Homo sapiens
LGTVERSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPRLQVHLEDPGYLEK

SEQ ID NO: 737516 - protein, 1274 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAETKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKR

SEQ ID NO: 737517 - protein, 375 aa, Homo sapiens
LVVVRPSFFIDEKIMEIHIQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPRLQVHLEDPGYLEK

SEQ ID NO: 737518 - protein, 912 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAETKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLTHFIPYNGSS

SEQ ID NO: 737519 - protein, 1556 aa, Homo sapiens; identical to SEQ ID NO: 737509

SEQ ID NO: 737520 - protein, 1556 aa, Homo sapiens; identical to SEQ ID NO: 737509

SEQ ID NO: 737521 - protein, 1549 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAETKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPRLQVHLEDPGYLEK

SEQ ID NO: 737522 - protein, 1314 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAETKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLDICRHSGSSRV

SEQ ID NO: 737523 - protein, 1256 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAETKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALWTEKLQVLGT

SEQ ID NO: 737524 - protein, 240 aa, Homo sapiens
MQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPRLQVHLEDPGYLEK

SEQ ID NO: 737525 - protein, 120 aa, Homo sapiens
GTTSCEFGTRENIHMLSEEKQRIMLLERTLQLKEEENKRLNQRLMSQSMSSVSSRHSEKIAIRDFQVGDLVLIILDERHDNYVLFTVSPTLYFLHSESLPALDLKPRLQVHLEDPGYLEK

SEQ ID NO: 737526 - protein, 211 aa, Homo sapiens
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 737527 - protein, 211 aa, Homo sapiens; identical to SEQ ID NO: 737526

SEQ ID NO: 737528 - protein, 126 aa, Homo sapiens
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGNSISVFFLL

SEQ ID NO: 737529 - protein, 118 aa, Homo sapiens
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKVF

SEQ ID NO: 737530 - protein, 90 aa, Homo sapiens
PVSCTQLFPAGGTRDRLEAELLPSPFLHASSVFSPESLLSQELFSRVGGLLRTPVRKMGGGAAQRVLTPRELGRRSLDNSWTSPVLLLTT

SEQ ID NO: 737531 - protein, 112 aa, Homo sapiens
MMGKLDNHMANKLQPHSFAKINSKWTKDLNVRAKTIKLLGCGSGFLDMTPNSQTTKEKIGKLYFIKILCIKEHYQQSKKITYGVGGNNMQFTYLIRIKHPEYIQNSQNATTV

SEQ ID NO: 737532 - protein, 86 aa, Homo sapiens
NTAALDSAHRVTAQAPCGRVGLRGSLQKKSPGVPFSTFLPGMQMKQPGQGSHLETSEPQLGQKPGPEHDVGGGQGLCGMAGKWPPP

SEQ ID NO: 737533 - protein, 95 aa, Homo sapiens
LAETTLLIFPPLQDHEHLQSLFLMGVHCQQANRFLHLSEIVFDVFDDEGVFFATAISFDHLTVWAARSRVCPFTLHDNPLPPNCESPKCLPAGEG

SEQ ID NO: 737534 - protein, 31 aa, Homo sapiens
MTFRKQEKMGKIGQARWLNLGGRGGQITSAQ

SEQ ID NO: 737535 - protein, 104 aa, Homo sapiens
RTYPGPGSMGGICKRVGVKTWLLKPRNYFQISFVLFFQCLNSQPMLSPTSSKEMIMAKPEQRRKRRKGGYLENKETDSCIYKIRCLSVEEGGNAVSPPYWTARL

SEQ ID NO: 737536 - protein, 104 aa, Homo sapiens; identical to SEQ ID NO: 737535

SEQ ID NO: 737537 - protein, 139 aa, Homo sapiens
MAGRGKGGQARRGDCSRSQNSARGAPGRPRGDRGRDRRGTAGIGARLQLPDCGGRVGTFPRSHPRTGFQGVKGNSPGRCKKATAPPRPASRLVHENHLEGRVQCPGATRHVVTALGWHRLVRGRRAAVSAPVRVCALAA

SEQ ID NO: 737538 - protein, 81 aa, Homo sapiens
LTFLGSSAAKSQQRRWSSFVRIASFAPNVKRTARMPQDTSSPGFCGACTVLNQPESCGSASPGCIADCRLHGGACAGERTC

SEQ ID NO: 737539 - protein, 134 aa, Homo sapiens
KRVCLYSLFNPVPPILPGICSTLAFVSTISLKPLAKITNILLTAKSSDQFSAGILPDPSAASDKVGYYCFPWCLEYHDLHLPVCSSICPADSMGPGEAPDHSSHSLGGLNPSYDFEQQFNANDFKFAFLILTSH

SEQ ID NO: 737540 - protein, 179 aa, Homo sapiens
LLPLRLWPRRSWGDGSIMASMQTTGRRVEVWFPKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHDDTC

SEQ ID NO: 737541 - protein, 168 aa, Homo sapiens
LLPLRLWPRRSWGDGSIMASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHDDTC

SEQ ID NO: 737542 - protein, 168 aa, Homo sapiens; identical to SEQ ID NO: 737541

SEQ ID NO: 737543 - protein, 178 aa, Homo sapiens
LLPLRLWPRRSWGDGSIMASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHGKFEHRDIHKGKKM

SEQ ID NO: 737544 - protein, 161 aa, Homo sapiens
GIMASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHELKSAFILSITD

SEQ ID NO: 737545 - protein, 179 aa, Homo sapiens; identical to SEQ ID NO: 737540

SEQ ID NO: 737546 - protein, 168 aa, Homo sapiens; identical to SEQ ID NO: 737541

SEQ ID NO: 737547 - protein, 249 aa, Homo sapiens
MIALYLGAGGVNYPQVELKSQEAQSLQQQQDQYLGHLQQYVATYQQQVVTYQQLTSEEEELHNQLLLQTQLVDRLQQQKAQSKAVAKMGCQELRETQEHLEAISQQNQQPQAQLSLMALPGEEMDSEEEEEVPQPMPSIPEDLESQKAMVAFFNSAVASAEEEQARLCGQLKECTASAWLICWPRPRRNLRQQRHAHKTGGDPMCGETHQALQGAMEKLWESTSHCTRARGQCGRRRSASAGWPRTRER

SEQ ID NO: 737548 - protein, 149 aa, Homo sapiens
MSLAEQGPPRWSSSYKQRLTTCRRSWRVWQLRAQEQDTEGFSHPNQEEEERLLELEQVAELLREQAESRRQILETMQNKCTTISHVLTQNHKLKEQLSPLQNGFIKLVPREADTKFWGLQLQWVAANCFSLSRLMRTWRSPVHCSWNST

SEQ ID NO: 737549 - protein, 141 aa, Homo sapiens
MIALYLGAGGVNYPQVELKSQEAQSLQQQQDQYLGHLQQYVATYQQQVVTYQQLTSEEEELHNQLLLQTQLVDRLQQQKAQSKAVAKMGCQELRETQEHLEAISQQNQQPQAQLSLMALPGEGTGDCSQEEERAPGGNGNC

SEQ ID NO: 737550 - protein, 137 aa, Homo sapiens
QRWAHSALVGLSEDLSGHPQQEMDSEEEEEVPQPMPSIPEDLESQKAMVAFFNSAVASAEEEQARLCGQLKECTASAWLICWPRPRRNLRQQRHAHKTGGDPMCGETHQALQGAMEKLWVSLSWHGPRRVGAGRSLP

SEQ ID NO: 737551 - protein, 233 aa, Homo sapiens
MIALYLGAGGVNYPQVELKSQEAQSLQQQQDQYLGHLQQYVATYQQQVVTYQQLTSEEEELHNQLLLQTQLVDRLQQQKAQSKAVAKMGCQELRETQEHLEAISQQNQQPQAQLSLMALPGEEMDSEEEEEVPQPMPSIPEDLESQKAMVAFFNSAVASAEEEQARLCGQLKECTASAWLICWPRPRRNLRQQRHAHKTGGDPMCGETHQALQGAMEKLWSRFMELMQERRWT

SEQ ID NO: 737552 - protein, 233 aa, Homo sapiens; identical to SEQ ID NO: 737551

SEQ ID NO: 737553 - protein, 97 aa, Homo sapiens
PPDSHNTPPHSHKTPPRRPLLKDPQSWCRPKAQETVLPRFSPRTWEAAALPSFYPRVAKHLTVVEASKPDQASRPSNVRAPPRVLAPPLGRSRPTPG

SEQ ID NO: 737554 - protein, 375 aa, Homo sapiens
MSGSQNNDKRQFLLERLLDAVKQCQIRFGGRKEIASDSDSRVTCLCAQFEAVLQHGLKRSRGLALTAAAIKQAAGFASKTETEPVFWYYVKEVLNKHELQRFYSLRHIASDVGRGRAWLRCALNEHSLERYLHMLLADRCRLSTFYEDWSFVMDEERSSMLPTMAAGLNSILFAINIDNKDLNGQSKFAPTVSDLLKESTQNVTSLLKESTQGVSSLFREITASSAVSILIKPEQETDPLPVVSRNVSADAKCKKERKKKKKVTNIISFDDEEDEQNSGDVFKKTPGAGESSEDNSDRSSVNIMSAFESPFGPNSNGSQSSNSWKIDSLSLNGEFGYQKLDVKSIDDEDVDENEDDVYGNSSGRKHRGHSESPEK

SEQ ID NO: 737555 - protein, 177 aa, Homo sapiens
QPQKRQRRRRGAGTGPGRGTMSGSQNNDKRQFLLERLLDAVKQCQIRFGGRKEIASDSDSRVTCLCAQFEAVLQHGLKRSRGLALTAAAIKQAAGFASKTETEPVFWYYVKEVLNKHELQRFYSLRHIASDVGRGRAWLRCALNEHSLERYLHMLLADRCRLRYVAGMRTGMGWSKR

SEQ ID NO: 737556 - protein, 198 aa, Homo sapiens
QPQKRQRRRRGAGTGPGRGTMSGSQNNDKRQFLLERLLDAVKQCQIRFGGRKEIASDSDSRVTCLCAQFEAVLQHGLKRSRGLALTAAAIKQAAGFASKTETEPVFWYYVKEVLNKHELQRFYSLRHIASDVGRGRAWLRCALNEHSLERYLHMLLADRCRLSTFYEDWSFVMDEERSSMLPTMAAGSERQYIGVPQA

SEQ ID NO: 737557 - protein, 288 aa, Homo sapiens
AARPSEWFFCATAARIGDPSASTTMPRSFLVRKPSDPNRKPNYSELQDSNPEFTFQQPYDQAHLLAAIPPPEILNPTASLPMLIWDSVLAPQAQPIAWASLRLQESPRVAELTSLSDEDSGKGSQPPSPPSPAPSSFSSTSVSSLEAEAYAAFPGLGQVPKQLAQLSEAKDLQARKAFNCKYCNKEYLSLGALKMHIRSHTLPCVCGTCGKAFSRPWLLQGHVRTHTGEKPFSCPHCSRAFADRSNLRAHLQTHSDVKKYQCQACARTFSRMSLLHKHQESGCSGCPR

SEQ ID NO: 737558 - protein, 95 aa, Homo sapiens
AARPSEWFFCATAARIGDPSASTTMPRSFLVRKPSDPNRKPNYSELQDSNPEFTFQQPYDQAHLLAAIPRGVTNYAIIHPQVQPQGLRRRWQTRV

SEQ ID NO: 737559 - protein, 288 aa, Homo sapiens; identical to SEQ ID NO: 737557

SEQ ID NO: 737560 - protein, 108 aa, Homo sapiens [sequence omitted]

SEQ ID NO: 737561 - protein, 237 aa, Homo sapiens
ESDAEEDTSLRVLVCPPVKLARNKPLTPGSVALSPRPHPMPPAPPSLPGSQEVRGLGGRPLPREAPRWHVGASAPGVSGLRAAHGVPRGLWRGRVLSSQKVRSRPGILARTECISSRAGRVRSGKGGCGQTGAALGQAGTMRPLLCALTGLALLRAAGSLAAAEPFSPPRGDSAQSTACDRHMAVQRRLDVMEEMVEKTVDHLGTEVKGLLGLLEELAWNLPPGPFSPAPDLLGDGF

SEQ ID NO: 737562 - protein, 237 aa, Homo sapiens; identical to SEQ ID NO: 737561

SEQ ID NO: 737563 - protein, 179 aa, Homo sapiens
ESDAEEDTSLRVLVCPPVKLARNKPLTPGSVALSPRPHPMPPAPPSLPGSQEVRGLGGRPLPREAPRWHVGASAPGVSGLRAAHGVPRGLWRGRVLSSQKVRSRPGILARTECISSRAGRVRSGKGGCGQTRRCARPGRHHAAPALRADRTGPAPRRGLFGRCRTLQPSARRLSSEHSV

SEQ ID NO: 737564 - protein, 74 aa, Homo sapiens
PSRHTEAAPGPLRALSTQACSSVCPDGLYSLCRPAGPQPPISGRRLAFPICRRAFFWQGAAAVCALDRKTSFHQ

SEQ ID NO: 737565 - protein, 149 aa, Homo sapiens
ATVGKMAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTQSDRMSKSKELLTQVLQLDTYIFSWKMYFPINLVE

SEQ ID NO: 737566 - protein, 114 aa, Homo sapiens
WSRRNPYVRMNFLRPSQLPGPLSALGAHGIFLVVGELNHCGPFGYCSWTHIFFLGRCISQSTWWNKNSENTIYFEAIFDQQMRTKYNHYLRNGQKLRWEAQRLEVAQCHYETQL

SEQ ID NO: 737567 - protein, 50 aa, Homo sapiens
DPSSDRLGVPVVQGVVSGLQPSAATRQGHTLPWDSPHCKVLDILVQPRTA

SEQ ID NO: 737568 - protein, 440 aa, Homo sapiens
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKASLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 737569 - protein, 147 aa, Homo sapiens
MLGLPWKGGLSWALLLLLLGSQILLIYAWHFHEQRDCDEHNVMARYLPATVEFAVHTFNQQSKDYYAYRLGHILNSWKEQVESKTVFSMELLLGRTRCGKFEDDIDNCHFQESTELNNTFTCFFTISTRPWMTQFSLLNKTCLEGFH

SEQ ID NO: 737570 - protein, 107 aa, Homo sapiens
RCNSYTHGSLQWDRLRPPPVLPPSIYTIRTCSQRLFAAAQSSSYSHMNVKGPLIQPHNTQGPFLTPSLSSLLFHQSSPACTLSAWPLSRYAQPGSALLTTPPRLQRG

SEQ ID NO: 737571 - protein, 120 aa, Homo sapiens
SPDIPYLSHTHPNNISCSLLSLRQPLNFTQPGALFTSCPEPVRTHSSAVHQSVGASLNCGDKQPPNFSGSKIFFLIYLHLMTGQVRGSSVLCHPNTGIQKEGGTVNEIPIAIEKRKKHAE

SEQ ID NO: 737572 - protein, 127 aa, Homo sapiens
MVFGYTQRRRLVGSHRSASSRAGRDQQLFLGDFHSPTPVSEAQHESRREFLFLLFPPSFVSSIPFSLLKCVGWSGMWAEKRGSWRHLILSSSLCKNASELPHTTCTINYKVKLCKPAALLAFCMLVR

SEQ ID NO: 737573 - protein, 106 aa, Homo sapiens
SSEGTLSEGQMDWSGRGPAHSADVPGHSSHVSSLQSGQAAEKCQSLLMRAGQERSRSELAWVGGRGWCKATLRPKACVARTNGGGGGRSGLRAQENEVALLVLPGK

SEQ ID NO: 737574 - protein, 538 aa, Homo sapiens
MNLELLESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQELQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKGKEKDSPFKPKLYKGDRGLPLEGSAKGKVQAELSQPLTAGGAISELL

SEQ ID NO: 737575 - protein, 538 aa, Homo sapiens; identical to SEQ ID NO: 737574

SEQ ID NO: 737576 - protein, 513 aa, Homo sapiens
MALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQELQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKGKEKDSPFKPKLYKGDRGLPLEGSAKGKVQAELSQPLTAGGAISELL

SEQ ID NO: 737577 - protein, 538 aa, Homo sapiens; identical to SEQ ID NO: 737574

SEQ ID NO: 737578 - protein, 200 aa, Homo sapiens
MNLELLESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTFLITKILL

SEQ ID NO: 737579 - protein, 538 aa, Homo sapiens; identical to SEQ ID NO: 737574

SEQ ID NO: 737580 - protein, 500 aa, Homo sapiens
MNLELLESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQELQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKAGGAISELL

SEQ ID NO: 737581 - protein, 288 aa, Homo sapiens
LEDPVSIPLRGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKGKEKDSPFKPKLYKGDRGLPLEGSAKGKVQAELSQPLTAGGAISELL

SEQ ID NO: 737582 - protein, 50 aa, Homo sapiens
MVSMAAAHCGDRQSGVSRGRRHVGRSGSRAQLQSPPWGTPGHAPSPAAVG

SEQ ID NO: 737583 - protein, 106 aa, Homo sapiens
KNRDRYILGGQHHWPGALSTLCACGPRRCLLSGGCSRSPRPSGASGRARAHAWTSPPGPRGTHRHGMAPVHGCVRAAGPPRARIWRARLASGGRGPPREQTRDPRG

SEQ ID NO: 737584 - protein, 485 aa, Homo sapiens
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAEDVPIAVEVHAISEDYDIETENNSSESLQDQTDEEPPAKLCKILDKSQALNVTAQQKWPLLRANSSGLYKCELCEFNSKYFSDLKQHMILKHKRTDSNVCRVCKESFSTNMLLIEHAKLHEEDPYICKYCDYKTVIFENLSQHIADTHFSDHLYWCEQCDVQFSSSSELYLHFQEHSCDEQYLCQFCEHETNDPEDLHSHVVNEHACKLIELSDKYNNGEHGQYSLLSKITFDKCKNFFVCQVCGFRSRLHTNVNRHVAIEHTKIFPHVCDDCGKGFSSMLEYCKHLNSHLSEGIYLCQYCEYSTGQIEDLKIHLDFKHSADLPHKCSDCLMRFGNERELISHLPVHETT

SEQ ID NO: 737585 - protein, 485 aa, Homo sapiens; identical to SEQ ID NO: 737584

SEQ ID NO: 737586 - protein, 485 aa, Homo sapiens; identical to SEQ ID NO: 737584

SEQ ID NO: 737587 - protein, 485 aa, Homo sapiens; identical to SEQ ID NO: 737584

SEQ ID NO: 737588 - protein, 88 aa, Homo sapiens
PLRCAAQARSVAARAVRPRSLGQGPGAQGVGRAGRERGRPSTASGSARAGAALPAAVRPREGPRGPSACALGRRRLCVGRPGGPRGTD

SEQ ID NO: 737589 - protein, 485 aa, Homo sapiens; identical to SEQ ID NO: 737584

SEQ ID NO: 737590 - protein, 263 aa, Homo sapiens
MILKHKRTDSNVCRVCKESFSTNMLLIEHAKLHEEDPYICKYCDYKTVIFENLSQHIADTHFSDHLYWCEQCDVQFSSSSELYLHFQEHSCDEQYLCQFCEHETNDPEDLHSHVVNEHACKLIELSDKYNNGEHGQYSLLSKITFDKCKNFFVCQVCGFRSRLHTNVNRHVAIEHTKIFPHVCDDCGKGFSSMLEYCKHLNSHLSEGIYLCQYCEYSTGQIEDLKIHLDFKHSADLPHKCSDCLMRFGNERELISHLPVHETT

SEQ ID NO: 737591 - protein, 485 aa, Homo sapiens; identical to SEQ ID NO: 737584

SEQ ID NO: 737592 - protein, 220 aa, Homo sapiens
MADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDRSVL

SEQ ID NO: 737593 - protein, 496 aa, Homo sapiens
MADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 737594 - protein, 496 aa, Homo sapiens; identical to SEQ ID NO: 737593

SEQ ID NO: 737595 - protein, 496 aa, Homo sapiens; identical to SEQ ID NO: 737593

SEQ ID NO: 737596 - protein, 296 aa, Homo sapiens
LPARPSVLDNGDRPQSSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 737597 - protein, 274 aa, Homo sapiens
MDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 737598 - protein, 302 aa, Homo sapiens
PATLEDPHRNPMSRMDSEDSIFCISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 737599 - protein, 287 aa, Homo sapiens [sequence omitted]

SEQ ID NO: 737600 - protein, 225 aa, Homo sapiens
RTLFLLIACRCQRGAVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 737601 - protein, 496 aa, Homo sapiens; identical to SEQ ID NO: 737593

SEQ ID NO: 737602 - protein, 510 aa, Homo sapiens
MADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRTLIRKVFNLYLSKQ

SEQ ID NO: 737603 - protein, 496 aa, Homo sapiens; identical to SEQ ID NO: 737593

SEQ ID NO: 737604 - protein, 532 aa, Homo sapiens
MADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYSNNAAEEVEEMEFHFLLPQAGCAVGANLGSPQPPVPGFKRFFCLSF

SEQ ID NO: 737605 - protein, 499 aa, Homo sapiens
MADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDINNAAEEVEEMEFHFLLPQAGCAVGANLGSPQPPVPGFKRFFCLSFLNSWD

SEQ ID NO: 737606 - protein, 102 aa, Homo sapiens
MNLFIMYMAGNTISIFPTMMVCMMAWRPIQALMAISATFKMLESSSQKFLQGLVYLIGNLMGLALAVYKCQSMGLLPTHASDWLAFIEPPERMEFSGGGLLL

SEQ ID NO: 737607 - protein, 143 aa, Homo sapiens
LVARSASASGTQIKPWLEYKDSYKGDKRCWDIALGPLKQIPMNLFIMYMAGNTISIFPTMMVCMMAWRPIQALMAISATFKMLESSSQKFLQGLVYLIGNLMGLALAVYKCQSMGLLPTHASDWLAFIEPPERMEFSGGGLLL

SEQ ID NO: 737608 - protein, 149 aa, Homo sapiens
MTAQGGLVANRGRRFKWAIELSGPGGGSRGRSDRGSGQGDSLYPVGYLDKQVPDTSVQETDRILVEKRCWDIALGPLKQIPMNLFIMYMAGNTISIFPTMMVCMMAWRPIQALMAISAKNGVQWWRTAFVNMRKQRLVPMYLGLIYILL

SEQ ID NO: 737609 - protein, 95 aa, Homo sapiens
THTSFKIAKGNPLRCWDIALGPLKQIPMNLFIMYMAGNTISIFPTMMVCMMAWRPIQALMAISAKNGVQWWRTAFVNMRKQRLVPMYLGLIYILL

SEQ ID NO: 737610 - protein, 102 aa, Homo sapiens; identical to SEQ ID NO: 737606

SEQ ID NO: 737611 - protein, 102 aa, Homo sapiens; identical to SEQ ID NO: 737606

SEQ ID NO: 737612 - protein, 102 aa, Homo sapiens; identical to SEQ ID NO: 737606

SEQ ID NO: 737613 - protein, 102 aa, Homo sapiens; identical to SEQ ID NO: 737606

SEQ ID NO: 737614 - protein, 102 aa, Homo sapiens; identical to SEQ ID NO: 737606

SEQ ID NO: 737615 - protein, 128 aa, Homo sapiens
LSNTLSKMKFAQRCWDIALGPLKQIPMNLFIMYMAGNTISIFPTMMVCMMAWRPIQALMAISATFKMLESSSQKFLQGLVYLIGNLMGLALAVYKCQSMGLLPTHASDWLAFIEPPERMEFSGGGLLL

SEQ ID NO: 737616 - protein, 129 aa, Homo sapiens
FFSTPPPQTTPLKRCWDIALGPLKQIPMNLFIMYMAGNTISIFPTMMVCMMAWRPIQALMAISATFKMLESSSQKFLQGLVYLIGNLMGLALAVYKCQSMGLLPTHASDWLAFIEPPERMEFSGGGLLL

SEQ ID NO: 737617 - protein, 158 aa, Homo sapiens
MNLFIMYMAGNTISIFPTMMVCMMAWRPIQALMAISATFKMLESSSQKFLQGLVYLIGNLMGLALAVYKCQSMGLLPTHASDWLAFIEPPETPPEALNGRGADKFRKMLDAKEQEMTEMRDVMQQQLAEYQELLDVKLALDMEINASGPFNASGPFNA

SEQ ID NO: 737618 - protein, 102 aa, Homo sapiens; identical to SEQ ID NO: 737606

SEQ ID NO: 737619 - protein, 102 aa, Homo sapiens; identical to SEQ ID NO: 737606

SEQ ID NO: 737620 - protein, 149 aa, Homo sapiens; identical to SEQ ID NO: 737608

SEQ ID NO: 737621 - protein, 208 aa, Homo sapiens
MVRGWVVVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 737622 - protein, 253 aa, Homo sapiens
DAWVDPRCRPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDCSVQ

SEQ ID NO: 737623 - protein, 958 aa, Homo sapiens
ELCERQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKQEGGGGRAERQAPGGAGDGATPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGEATRGTRRRHCWSCWTRAECQLPGPLPGRARGLVQGAVHLHGNVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 737624 - protein, 917 aa, Homo sapiens
MCEPEYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGEATRGTRRRHCWSCWTQEKLALQERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 737625 - protein, 681 aa, Homo sapiens
MCEPEYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVRAERPGEPYPGNAVCKDEASLPGPRDPRSQLRGAIAVIAGPDWHGRVPYNQEATHRRLASPRRVWVQSQSGYPKADLRYT

SEQ ID NO: 737626 - protein, 670 aa, Homo sapiens
MCEPEYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 737627 - protein, 465 aa, Homo sapiens
MEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGEATRGTRRRHCWSCWTRAECQLPGPLPGRARGLVQGAVHLHGNVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 737628 - protein, 968 aa, Homo sapiens
ELCERQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGEATRGTRRRHCWSCWTRAECQLPGPLPGRARGLVQGAVHLHGNVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 737629 - protein, 881 aa, Homo sapiens
ELCEPRVWPGYGGEHWLRATVGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGEATRGTRRRHCWSCWTRAECQLPGPLPGRARGLVQGAVHLHGNVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 737630 - protein, 716 aa, Homo sapiens
SCRFGTSKYSNENLDLAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGEATRGTRRRHCWSCWTRAECQLPGPLPGRARGLVQGAVHLHGNVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 737631 - protein, 477 aa, Homo sapiens
ELCERQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDCSVQ

SEQ ID NO: 737632 - protein, 135 aa, Homo sapiens
ELCEPRVWPGYGGEHWLRATVGSAGAGEGPVITALTPMTIPDVFPHLPLIAITRNPVFPRFIKIIEVKNKKLVELLRRKVRLAQPYVGVFLKRDDSNESDVVESLDEIYHTGTAGGGCQALSGPELDVRPCLGQN

SEQ ID NO: 737633 - protein, 119 aa, Homo sapiens
CSLQCCLAFGGLGLSPLFMSDVRHRSECVVGRSPFPEPPPALRRSRAPLSLTQHPPRGAASPRRSLDPQHCLLTIMAGTIRKRSSGSSFYSRVVMATKNTLAEAGSRSDVRLTNNSQGK

SEQ ID NO: 737634 - protein, 84 aa, Homo sapiens
MRGRGAPGPSGFLHDTFVQSKTRSHFDSPLSRSLLQISRLAARSLHAVLKKQIPHPPFNSFPGGNPPPNLWKRYTSSSLIKAGG

SEQ ID NO: 737635 - protein, 98 aa, Homo sapiens
SAGEEWRGPWRQTLHALGTPCRECSRRFRVSRRGHGPDRQRLGLQLCMALTPPDLAPHPHCGVGGFTWVLHLRFPGRSSAPCLGHPGPCSVGPTHAGV

SEQ ID NO: 737636 - protein, 203 aa, Homo sapiens
MVRAWLLWAVRCTSETLQSPRPETFHPQASRSFLPPASHRSSLLLSLAPTAPSPCLPFPVILAWPCQAVKPGQTTLLCAHPGQAGAGQQVADGCGRRQGPPLGLSSQSWPLLFFPSAESLCSAFREGRCGWLPPAPCPPPGLHLFSLLEQLVFSGKVLAQSTPGKSHGEARKQFPPWPLSCQHSFLTHHLMLLLSPQLEPTVL

SEQ ID NO: 737637 - protein, 110 aa, Homo sapiens
MGRDRAQIKWTQPFDLMGCTAHGGTLPWEFFLDLETFPNWNPLSSATSVPDLVGLSSGISFQRHFLFGVIPSAVMDSMNKYGYLNVFVQYENQNELVEALQISWSDPFYR

SEQ ID NO: 737638 - protein, 320 aa, Homo sapiens
PPALEAAARCATASRHPCPPDSAAACPAMGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 737639 - protein, 79 aa, Homo sapiens
FRTMTVLKTGVRPEFRIQVCMFQGLHMEELQIDMCFCVCVCLPFFLSGGFYRLLGSRVDVGRAGRRGPQLRFGALDVHT

SEQ ID NO: 737640 - protein, 320 aa, Homo sapiens; identical to SEQ ID NO: 737638

SEQ ID NO: 737641 - protein, 320 aa, Homo sapiens; identical to SEQ ID NO: 737638

SEQ ID NO: 737642 - protein, 292 aa, Homo sapiens
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 737643 - protein, 295 aa, Homo sapiens
KQAVLVGGFLVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 737644 - protein, 279 aa, Homo sapiens
MELAEGLGVSATCVDDVLGVVPVGPCVVDKGGDEGGCSVIHLTLVLRCGLDHYWGNTCIGWSRVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 737645 - protein, 208 aa, Homo sapiens
GKVEAGGASGREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 737646 - protein, 214 aa, Homo sapiens
ATPSACCNTAVLLLTHNSWEGGEGTPEREVWAQASPPTHCVSNLSPDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 737647 - protein, 147 aa, Homo sapiens
RLGRGRGESAEAINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 737648 - protein, 149 aa, Homo sapiens [sequence omitted]

SEQ ID NO: 737649 - protein, 131 aa, Homo sapiens
QASRALWFIGRGCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 737650 - protein, 320 aa, Homo sapiens; identical to SEQ ID NO: 737638

SEQ ID NO: 737651 - protein, 320 aa, Homo sapiens; identical to SEQ ID NO: 737638

SEQ ID NO: 737652 - protein, 320 aa, Homo sapiens; identical to SEQ ID NO: 737638

SEQ ID NO: 737653 - protein, 320 aa, Homo sapiens; identical to SEQ ID NO: 737638

SEQ ID NO: 737654 - protein, 320 aa, Homo sapiens; identical to SEQ ID NO: 737638

SEQ ID NO: 737655 - protein, 186 aa, Homo sapiens
PPALEAAARCATASRHPCPPDSAAACPAMGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPFWMYIHK

SEQ ID NO: 737656 - protein, 615 aa, Homo sapiens
MHRGLIHPQSRAVGGDAMTPIVTVLICLGLSLGPRTRVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVMAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 737657 - protein, 615 aa, Homo sapiens; identical to SEQ ID NO: 737656

SEQ ID NO: 737658 - protein, 640 aa, Homo sapiens
GSHCYPHQEGQTQEAPVLFAATSRLSHRGLIHPQSRAVGGDAMTPIVTVLICLGLSLGPRTRVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVMAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 737659 - protein, 615 aa, Homo sapiens; identical to SEQ ID NO: 737656

SEQ ID NO: 737660 - protein, 527 aa, Homo sapiens
MHRGLIHPQSRAVGGDAMTPIVTVLICLGLSLGPRTRVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVMAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSSPAQLPTPRKKTSMLP

SEQ ID NO: 737661 - protein, 68 aa, Homo sapiens
VLGKRRLVFLQLLNLKNTDKRHRESPPADAHRQHLLSPAWPEMKEVVEQPSAAGCGRGVRSVAKEDIK

SEQ ID NO: 737662 - protein, 111 aa, Homo sapiens
MPRVSDRARVLSSIFRAGYSWVLELYQAVFPKGAQREGPSPGTVREPLPQTVPVLQGPRRCCPRDPGACPGGAGRGPPLSPSSLSPGPPASRSPGAGSARLTALQLPRSRP

SEQ ID NO: 737663 - protein, 81 aa, Homo sapiens
LFYIEGNTTANILCTHCYARWEYFCEYITESGIAALEGMYTLNCPGDYHIARHKAAPVFSRPLAHEPACLLVSRPTQDCPC

SEQ ID NO: 737664 - protein, 145 aa, Homo sapiens
LLSQPSLLTSPQGWSQGGRPLAPPLSTCGPQPRILPSCSDEWHRCPAQAGKPLPETDSAGGNSSNRFYRKPLKWRLRPHLAPGPHSTEKKIHPAWGWGLPEMATLWQESLRILSEPGLWELTEGGREREREKEREIIPECAGEEA

SEQ ID NO: 737665 - protein, 136 aa, Homo sapiens
SRILQAGLDVERLSLRNFFHHFHSKRGMWSRRQMKTLEPEGVRGAQHSPLWTSSGSPGPCYCSGMGSGVTAGPQEASKLTAHSTWSCPLTEAGSGAPVSASWAFRREDFEREARRDHLLSREREELLRRTGQEGEI

SEQ ID NO: 737666 - protein, 203 aa, Homo sapiens
MGGGDLNLKKSWHPQTLRNVEKVWKAEQKHEAERKKIEELQRELREERAREEMQRYAEDVGAVKKKEEKLDWMYQGPGGMVNRDEYLLGRPIDKYVFEKMEEKEAGCSSETGLLPGSIFAPSGANSLLDMASKIREDPLFIIRKKEEEKKREVLNNPVKMKKIKELRQRIWKKGEKKSLYTNKKNSGGGRNPIRPKGNDYKLR

SEQ ID NO: 737667 - protein, 425 aa, Homo sapiens
MGGGDLNLKKSWHPQTLRNVEKVWKAEQKHEAERKKIEELQRELREERAREEMQRYAEDVGAVKKKEEKLDWMYQGPGGMVNRDEYLLGRPIDKYVFEKMEEKEAGCSSETGLLPGSIFAPSGANSLLDMASKIREDPLFIIRKKEEEKKREVLNNPVKMKKIKELLQMSLEKKEKKKKKEKKKKHKKHKHRSSSSDRSSSEDEHSAGRSQKKMANSSPVLSKVPGYGLQVRNSDRNQGLQGPLTAEQKRGHGMKNHSRSRSSSHSPPRHASKKSTREAGSRDRRSRSLGRRSRSPRPSKLHNSKVNRRETGQTRSPSPKKEVYQRRHAPGYTRKLSAEELERKRQEMMENAKWREEERLNILKRHAKDEEREQRLEKLDSRDGKFIHRMKLESASTSSLEDRVKRNIYSLQRTSVALEKNFMKR

SEQ ID NO: 737668 - protein, 438 aa, Homo sapiens
PFTIGNACVVRVGDGRRDLNLKKSWHPQTLRNVEKVWKAEQKHEAERKKIEELQRELREERAREEMQRYAEDVGAVKKKEEKLDWMYQGPGGMVNRDEYLLGRPIDKYVFEKMEEKEAGCSSETGLLPGSIFAPSGANSLLDMASKIREDPLFIIRKKEEEKKREVLNNPVKMKKIKELLQMSLEKKEKKKKKEKKKKHKKHKHRSSSSDRSSSEDEHSAGRSQKKMANSSPVLSKVPGYGLQVRNSDRNQGLQGPLTAEQKRGHGMKNHSRSRSSSHSPPRHASKKSTREAGSRDRRSRSLGRRSRSPRPSKLHNSKVNRRETGQTRSPSPKKEVYQRRHAPGYTRKLSAEELERKRQEMMENAKWREEERLNILKRHAKDEEREQRLEKLDSRDGKFIHRMKLESASTSSLEDRVKRNIYSLQRTSVALEKNFMKR

SEQ ID NO: 737669 - protein, 425 aa, Homo sapiens; identical to SEQ ID NO: 737667

SEQ ID NO: 737670 - protein, 408 aa, Homo sapiens
MGGGDLNLKKSWHPQTLRNVEKVWKAEQKHEAERKKIEELQRELREERAREEMQRYAEDVGAVKKKEEKLDWMYQGPGGMVNRDEYLLGRPIDKYVFEKMEEKEAGCSSETGLLPGSIFAPSGANSLLDMASKIREDPLFIIRKKEEEKKREVLNNPVKMKKIKELLQMSLEKKEKKKKKEKKKKHKKHKHRSSSSDRSSSEDEHSAGRSQKKMANSSPVLSKVPGYGLQVRNSDRNQGLQGPLTAEQSPPRHASKKSTREAGSRDRRSRSLGRRSRSPRPSKLHNSKVNRRETGQTRSPSPKKEVYQRRHAPGYTRKLSAEELERKRQEMMENAKWREEERLNILKRHAKDEEREQRLEKLDSRDGKFIHRMKLESASTSSLEDRVKRNIYSLQRTSVALEKNFMKR

SEQ ID NO: 737671 - protein, 519 aa, Homo sapiens
MARDLVMFRDVAVDFSQEEWECLNSYQRNLYRDVILENYSNLVSLAGCSISKPDVITLLEQGKEPWMVVRDEKRRWTLDLESRYDTKKLFQGKDIYEMNLSQWKVMERIKSCGLEEQESPHEVCFRQVTKTTSEKMPTYRKLTSLPLYQKSHNREKPYECGECGKAFRVRQQLTFHQRIHTGEKPYECKECGKAFRQCAHLSRHQRIHTSDKLYECKKCGKIFTCGSDLRVHQRIHIGEKPYECKECGKAFRVRGQLNLHQRIHTGEKPYECKECGKAFRQYAHLTRHQRLNIAEKCYECKECGQAFLCSTGLRLHHKLHTGEKPYECKECGKAFRVRQQLTLHQRIHTGEKPYDCKECGKTFSRGYHLTLHQRIHTGEKPYECKECQKFFRRYSELISHQGIHIGEKPYECKECGKAFRLFSQLTQHQSIHFGEKPFKCKECEKTFRLLSQLTQHQSIHTGEKPYDCKECGKAFRLHSSLIQHQRIHSGEKPYKCKECKKAFRQHSHLTYHQRIHNVT

SEQ ID NO: 737672 - protein, 468 aa, Homo sapiens
VTDFYYKVFVCLFCVEQENMFWSCFLSDLESRYDTKKLFQGKDIYEMNLSQWKVMERIKSCGLEEQESPHEVCFRQVTKTTSEKMPTYRKLTSLPLYQKSHNREKPYECGECGKAFRVRQQLTFHQRIHTGEKPYECKECGKAFRQCAHLSRHQRIHTSDKLYECKKCGKIFTCGSDLRVHQRIHIGEKPYECKECGKAFRVRGQLNLHQRIHTGEKPYECKECGKAFRQYAHLTRHQRLNIAEKCYECKECGQAFLCSTGLRLHHKLHTGEKPYECKECGKAFRVRQQLTLHQRIHTGEKPYDCKECGKTFSRGYHLTLHQRIHTGEKPYECKECQKFFRRYSELISHQGIHIGEKPYECKECGKAFRLFSQLTQHQSIHFGEKPFKCKECEKTFRLLSQLTQHQSIHTGEKPYDCKECGKAFRLHSSLIQHQRIHSGEKPYKCKECKKAFRQHSHLTYHQRIHNVT

SEQ ID NO: 737673 - protein, 468 aa, Homo sapiens; identical to SEQ ID NO: 737672

SEQ ID NO: 737674 - protein, 263 aa, Homo sapiens
MGGKAPQAQSLLSSLQQAEFKKQIFYTMSYASLSRAQATTSSCLQACIFLWEASPLTLHQGPGLRGDGGRFPCSRRFWEQVPEAEAMASEQVAASPPPEPAALTASHIAPASAWAKAPGVIKDSVFTSSGPRETSLAPEEGLAEPQAPVHTHRPQVWPWAGPWCADSSGHCSRAFAPACCRSRRSWGVEPQRPLVFLPLLGDGCSSWLFPESVFVIWLLETPSDETGSVGLACQAEAVGAQESHHEAGGRGPIAPPCRPGPGT

SEQ ID NO: 737675 - protein, 135 aa, Homo sapiens
ISTIRVKNKESSRKGLGVCYVRNTKSVHCFQAFLTKVNSHSSFWSINAELFLNSETLGNLSVLLTAIFFLFCFLFQIPGILLKSGCCRPWRDARLLGESGWGTCQRSRAVPLQAGSTTTSKQKAAVIHNSAHYRH

SEQ ID NO: 737676 - protein, 113 aa, Homo sapiens
RKSYPGAASATQLFVHAGALFPSSGVCLCDFMPGPTLGWLIRVAGEDWGLEDKQEQLATHRTIRPVDPGVPQRGSTCTGLPSTPAAWALSAIAAFDVQVDHSPMLYAINNSVF

SEQ ID NO: 737677 - protein, 615 aa, Homo sapiens
MHRGLIHPQSRAVGGDAMTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEDEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAYNLSSEWSAPSDPLDILITGQIHGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 737678 - protein, 304 aa, Homo sapiens
FISVQPGPTVASGENVTLLCQSWRQFHTFLLTKAGADCPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 737679 - protein, 223 aa, Homo sapiens [sequence omitted]

SEQ ID NO: 737680 - protein, 102 aa, Homo sapiens [sequence omitted]

SEQ ID NO: 737681 - protein, 276 aa, Homo sapiens
ERLRECTEIRNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPGRLQLRSHGFETSRGHVQQQQAVTGPMPSQPLPLDASWLGVKQTNGKKPVLV

SEQ ID NO: 737682 - protein, 112 aa, Homo sapiens
RAGPASFWNTFEIFAFVRFQPFGGDSESLNLEARREGKWRPPGSGQPGRRARGTQGHRPPETSGSSRHSPCGIKNGYSGCHGNQPSPPSVSLNLCRPFLAKIQANRFVLTLR

SEQ ID NO: 737683 - protein, 107 aa, Homo sapiens
LPPTPSASGASRFADTAFPRVKCRVASGGLGIFQQEEPSGISSSPCCPPAGLETPPGMVFLPASSCCINEKNPQEPPPGRMAPFAVCRLPALWLGHLSCAMPPDQVP

SEQ ID NO: 737684 - protein, 82 aa, Homo sapiens
AYIIRPPADRSRRANPAVGPSLATAASLRSLRRASVLAGALVSHCVLQGQNGTDGEIEMRAHPQDYPSMSTNSNLIHKITHQ

SEQ ID NO: 737685 - protein, 67 aa, Homo sapiens
VATGAGSEPSHCVLSWVQKLSFGVEGTVGQGPSLKKLQLTESPSRPLKDYISVCRDAPLHELHLHCA

SEQ ID NO: 737686 - protein, 95 aa, Homo sapiens
ENPDGQSLGRRAWPRCPHWVETPCTWSTCALQPGHQTWSKPLQGWLQQLPDTQEGPGWAGNTCSQQPSPRKDPVASVEQRRVKFMGWKSYPEAAH

SEQ ID NO: 737687 - protein, 412 aa, Homo sapiens
RTQTGRAWVGEPGPAVPTGWRHHVLGPLVLFSQDTRHGPNRCRAGCSNSLTLRKAQAGQAIPAPNSHACRLPLQDSPVPRTKMTPNSTGEVPSPIPKGALGLSLALASLIITANLLLALGIAWDRRLRSPPAGCFFLSLLLAGLLTGLALPTLPGLWNQSRRGYWSCLLVYLAPNFSFLSLLANLLLVHGERYMAVLRPLQPPGSIRLALLLTWAGPLLFASLPALGWNHWTPGANCSSQAIFPAPYLYLEVYGLLLPAVGAAAFLSVRVLATAHRQLQDICRLERAVCRDEALRLARALTWRQARAQAGAMLLFGLCWGPYVATLLLSVLAYEQRPPLGPGTLLSLLSLGSASAAAVPVAMGLGDQRYTAPWRAAAQRCLQGLWGRASRDSPGPSIAYHPSSQSSVDLDLN

SEQ ID NO: 737688 - protein, 330 aa, Homo sapiens
MTPNSTGEVPSPIPKGALGLSLALASLIITANLLLALGIAWDRRLRSPPAGCFFLSLLLAGLLTGLALPTLPGLWNQSRRGYWSCLLVYLAPNFSFLSLLANLLLVHGERYMAVLRPLQPPGSIRLALLLTWAGPLLFASLPALGWNHWTPGANCSSQAIFPAPYLYLEVYGLLLPAVGAAAFLSVRVLATAHRQLQDICRLERAVCRDEALRLARALTWRQARAQAGAMLLFGLCWGPYVATLLLSVLAYEQRPPLGPGTLLSLLSLGSASAAAVPVAMGLGDQRYTAPWRAAAQRCLQGLWGRASRDSPGPSIAYHPSSQSSVDLDLN

SEQ ID NO: 737689 - protein, 330 aa, Homo sapiens; identical to SEQ ID NO: 737688

SEQ ID NO: 737690 - protein, 162 aa, Homo sapiens
ENPDGQSLGRRAWPRCPHWVETPCTWSTCALQPGHQTWSKPLQGWLQQLPDTQEGPGWAGNTCSQQPCMPAAAPGLPCPQDQDDQRPPLGPGTLLSLLSLGSASAAAVPVAMGLGDQRYTAPWRAAAQRCLQGLWGRASRDSPGPSIAYHPSSQSSVDLDLN

SEQ ID NO: 737691 - protein, 130 aa, Homo sapiens
LGPASIEGILAKTGPAAAPATGAWDTVVPPLPRKCQCSGSARSHGAGRSALHSPLEGSRPKVPAGAVGKSLPGQSRPQHCLPPKQPKQCRPGLELKEGPLLTPTRASVQLSHPACLYWAPLLWIRDPASV

SEQ ID NO: 737692 - protein, 137 aa, Homo sapiens
SVSKKKKKKKKKEQLSPGVAYVRHLPNLLNETQILSYFSQCGTVTRFRLSRKKRTGNSKGYAFVEFESEDVAKIVAETMNNYMFGERLLESHFMPPEKVQKELFQDWNIPFKQQSYPSVKCIIRTCTYTRATDGGVI

SEQ ID NO: 737693 - protein, 2087 aa, Homo sapiens
HKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGASTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 737694 - protein, 2004 aa, Homo sapiens
HKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGASTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLSNAISTALPLTQLRWVKQTNTEKKASVVTLPVYLNFTRADLIFTVDFEIATKEDPRSFYERGVAVLCTE

SEQ ID NO: 737695 - protein, 671 aa, Homo sapiens
VPVSAPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 737696 - protein, 650 aa, Homo sapiens
VPVSAPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 737697 - protein, 1912 aa, Homo sapiens
HKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGASTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFKFLSDPQVHTVLVERSTLKEDVGDEGEEEKEFISYNINIDIHYGVKSIAWQSLRTPVTIIT

SEQ ID NO: 737698 - protein, 465 aa, Homo sapiens
SKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 737699 - protein, 73 aa, Homo sapiens
VKLSSQKTPKPQTKELNALVHAAGAYLEALSHLQGKGPFSGDVAFLKDLGTLGGFAKMSLRRKIGFLTCDFLK

SEQ ID NO: 737700 - protein, 446 aa, Homo sapiens
SKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKIGFLTCDFLK

SEQ ID NO: 737701 - protein, 465 aa, Homo sapiens; identical to SEQ ID NO: 737698

SEQ ID NO: 737702 - protein, 173 aa, Homo sapiens [sequence omitted]

SEQ ID NO: 737703 - protein, 173 aa, Homo sapiens [sequence omitted]

SEQ ID NO: 737704 - protein, 103 aa, Homo sapiens
VTISRLHREARCGGGAPAHGTWKVLGQNPAPALMCGSISGNFHFLLCLRRRGPADVSVSWSSGQSNLHHGCLPSCRVNVAGRPLHPTSCMDMAPWLCPTSLPA

SEQ ID NO: 737705 - protein, 232 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREAAGYLKHRLAHVPTLVASSNQVCGCGEPWLGELWDDPEDIQSSEKPWYTDADRGKRLGLEQESNGGPRGRHGRRTRGQPGGTGQNRPDKPVRGPKHGGKARGE

SEQ ID NO: 737706 - protein, 139 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKGTVKGMGRRACAGFCKQ

SEQ ID NO: 737707 - protein, 153 aa, Homo sapiens
MGTQTRGDPNLLSWRQGLLQGKFPEASLPCRVARPECDSGGEKQWLSEEAENLCSLLPGTPLGSHTVERGCNTPSRQEGLLYCPGRECRSGGWDLSIHTLLPGPVWDLAQAPSPSDASDSEESNFLPLSLQDWRAWKYSEGCGVDRSFRQGTR

SEQ ID NO: 737708 - protein, 524 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 737709 - protein, 351 aa, Homo sapiens
MYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 737710 - protein, 345 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGVSLRTPSVFPLCWSAPGLYPVHIF

SEQ ID NO: 737711 - protein, 524 aa, Homo sapiens; identical to SEQ ID NO: 737708

SEQ ID NO: 737712 - protein, 482 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFLVGGLGTHLEGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 737713 - protein, 249 aa, Homo sapiens
MRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 737714 - protein, 351 aa, Homo sapiens; identical to SEQ ID NO: 737709

SEQ ID NO: 737715 - protein, 528 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETVLMIP

SEQ ID NO: 737716 - protein, 120 aa, Homo sapiens
ERERERERERERERERERERERERERERERERERAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 737717 - protein, 718 aa, Homo sapiens
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGPNMVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKEFAGGIYSRLEAQIKASVPVSARQSSSEKNTRSKSRFGQGRPA

SEQ ID NO: 737718 - protein, 718 aa, Homo sapiens; identical to SEQ ID NO: 737717

SEQ ID NO: 737719 - protein, 572 aa, Homo sapiens
MVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKEFAGGIYSRLEAQIKASVPVSARQSSSEKNTRSKSRFGQGRPA

SEQ ID NO: 737720 - protein, 707 aa, Homo sapiens
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGPNMVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKETDKLRPRDGTVSKSNRKSGLSSVLLMTVLLC

SEQ ID NO: 737721 - protein, 230 aa, Homo sapiens
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGPNMVIHVCDEAKNLKEDFTCPRDLLISEMKYFAEYLSMDAQRWEEVDISVHCDVHIFNWLIKYIKRNTKENKDCEMPTLGKKQSVA

SEQ ID NO: 737722 - protein, 379 aa, Homo sapiens
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGPNMVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRCREDKIHTCIFVYIYI

SEQ ID NO: 737723 - protein, 523 aa, Homo sapiens
LRNSGLSYCSKFIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKEFAGGIYSRLEAQIKASVPVSARQSSSEKNTRSKSRFGQGRPA

SEQ ID NO: 737724 - protein, 155 aa, Homo sapiens
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGDVVSLCCPVWS

SEQ ID NO: 737725 - protein, 127 aa, Homo sapiens
QPLPCTKQRGWTPLSWHQLPLLPQHSLDLGGLFGKASGCHGLHDQPTRLLLLANIASIEGFLQPPALELSGTKHFPRLPTRTNWASGCRCGLQGSGRASPESSGTQPFTPCPVLLTSALSLQHFLEA

SEQ ID NO: 737726 - protein, 74 aa, Homo sapiens
RKAQTFLLLEHPRALDPLCPSEMGCHSSKSTTVAAESQKLEEEREGREPGLETGTQAADCKDAPLKDGTPEPKS

SEQ ID NO: 737727 - protein, 74 aa, Homo sapiens; identical to SEQ ID NO: 737726

SEQ ID NO: 737728 - protein, 240 aa, Homo sapiens
ALPVCGKAGSTPGRRVAADIMSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVDSGSEIKSYLVRLLTYLPGRPIAELPVSPQLLYEIGKLAAKLDKTLQRFHHPKLSSLHRENFIWNLKNVPLLEKYLYALGQNRNREIVEHVIHLFKEEVMTKLSHFRE

SEQ ID NO: 737729 - protein, 102 aa, Homo sapiens
GRLLLLNWRPRRPKASKNPDLIEVQNHIIMFLKAAGFPTASVCHTKGDNTASLVSVDSGSEIKSYLVRLLTYLPGRPIAELPVSPQLLYEIGKLGPSTVPGP

SEQ ID NO: 737730 - protein, 162 aa, Homo sapiens
MPNIPGDLESREAMVAFFNSAGASAQEEQRVCCQPLAHPVASSQKKPEVAAPAPESGGESVFGETHRALQGAMEKLQRLYEKEKVDLKERVEKLELQFIHLSGQTDTIESTSARGQCQRRSTGRGGHRQAGPGPGGDEGEPAGAAGQVLQLVGDHKEGHGKF

SEQ ID NO: 737731 - protein, 94 aa, Homo sapiens
MAHHSLNTFYIWHNNVLHTHLVFFLPHLLNQPFSRGSFLIWLLLCWNSWYHLRTLRRQANQANKLSMMLLRVKQSPGTKLCHGDSELTSGLLAT

SEQ ID NO: 737732 - protein, 126 aa, Homo sapiens
SGIRSHCSTGALHPGHQWPPHGKIHGQVSVLVLLGLAQLTALALFDFRPHALLVFLLPHWSHRLSFLSSPQPLNVGMTRGSVLHPLLLSICAHSLGNFTQSHCLQYHLHVALTFTSLASSSHLNSD

SEQ ID NO: 737733 - protein, 104 aa, Homo sapiens
DGVLLLLPGLQCNGAISVHCDLRLSGSSDSPFSAYRVAGITGACHQARLIFVFLVETGFHYVDQAGLELLTSGDPPALASQSAGITDVSHRPGLNLTIFKYTFQ

SEQ ID NO: 737734 - protein, 349 aa, Homo sapiens
MNSTLDGNQSSHPFCLLAFGYLETVNFCLLEVLIIVFLTVLIISGNIIVIFVFHCAPLLNHHTTSYFIQTMAYADLFVGVSCVVPSLSLLHHPLPVEESLTCQIFGFVVSVLKSVSMASLACISIDRYIAITKPLTYNTLVTPWRLRLCIFLIWLYSTLVFLPSFFHWGKPGYHGDVFQWCAESWHTDSYFTLFIVMMLYAPAALIVCFTYFNIFRICQQHTKDISERQARFSSQSGETGEVQACPDKRYAMVLFRITSVFYILWLPYIIYFLLESSTGHSNRFASFLTTWLAISNSFCNCVIYSLSNSVFQRGLKRLSGAMCTSCASQTTANDPYTVRSKGPLNGCHI

SEQ ID NO: 737735 - protein, 112 aa, Homo sapiens
SRLKLCPLAGLTGVCWAWTPASGLWLACTFPIKPSKYLQPLRPLIAFDPGCCCEMPLLTHAFLKTALPCASLIIQLLIVSKRKPENANSGPSPPLWSPSRPLCRRPGAQEML

SEQ ID NO: 737736 - protein, 328 aa, Homo sapiens
AGLTAAFRVMGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKTHIFGADGARKLAQTLGLEVLGDIPLHLNIREASDTGQPIVFSQPESDEAKAYLRIAVEVVRRLPSPSE

SEQ ID NO: 737737 - protein, 328 aa, Homo sapiens; identical to SEQ ID NO: 737736

SEQ ID NO: 737738 - protein, 307 aa, Homo sapiens
AGLTAAFRVMGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKRDIPLHLNIREASDTGQPIVFSQPESDEAKAYLRIAVEVVRRLPSPSE

SEQ ID NO: 737739 - protein, 189 aa, Homo sapiens
MRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKTHIFGADGARKLAQTLGLEVLGDIPLHLNIREASDTGQPIVFSQPESDEAKAYLRIAVEVVRRLPSPSE

SEQ ID NO: 737740 - protein, 159 aa, Homo sapiens
MSRRNCWICKMCRDESKRPPSNLTLEEVLQWAQSFENLMATKYGPVVYAAYLKMEHSDENIQFWMACETYKKIASRWSRISRAKKLYKIYIQPQSPREINIDSSTRETIIRNIQEPTETCFEEAQKIVYMHMERDSYPRFLKSEMYQKLLKTMQSNNSF

SEQ ID NO: 737741 - protein, 159 aa, Homo sapiens; identical to SEQ ID NO: 737740

SEQ ID NO: 737742 - protein, 159 aa, Homo sapiens; identical to SEQ ID NO: 737740

SEQ ID NO: 737743 - protein, 159 aa, Homo sapiens; identical to SEQ ID NO: 737740

SEQ ID NO: 737744 - protein, 74 aa, Homo sapiens [sequence omitted]

SEQ ID NO: 737745 - protein, 143 aa, Homo sapiens
TPRYSPAGPQRQSRPGAVHAGTRRSEAEAAPPHSAPCGREERRRQRESVLRGGARAPSVRAAARRSLRDPWTPGSACEGCGRRRDEGADGRGNGGAGEHGESRNRERVGTATGRRAPQKPGLRGSERVRVRCCSFQSCPQVRD

SEQ ID NO: 737746 - protein, 909 aa, Homo sapiens
EHAENCSRPGSLWQRRRRGPGPSNPARARLPQQPPPLPPLGHEPSFLLPPAALPAAAAASRLWASAGNMPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 737747 - protein, 381 aa, Homo sapiens
EHAENCSRPGSLWQRRRRGPGPSNPARARLPQQPPPLPPLGHEPSFLLPPAALPAAAAASRLWASAGNMPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVNPPPTTLF

SEQ ID NO: 737748 - protein, 727 aa, Homo sapiens
EHAENCSRPGSLWQRRRRGPGPSNPARARLPQQPPPLPPLGHEPSFLLPPAALPAAAAASRLWASAGNMPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKKGNRFIVCLRMS

SEQ ID NO: 737749 - protein, 863 aa, Homo sapiens
EHAENCSRPGSLWQRRRRGPGPSNPARARLPQQPPPLPPLGHEPSFLLPPAALPAAAAASRLWASAGNMPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 737750 - protein, 905 aa, Homo sapiens
EHAENCSRPGSLWQRRRRGPGPSNPARARLPQQPPPLPPLGHEPSFLLPPAALPAAAAASRLWASAGNMPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREKRNWTEQNNMKQDHKRKKTLAFIFSL

SEQ ID NO: 737751 - protein, 909 aa, Homo sapiens; identical to SEQ ID NO: 737746

SEQ ID NO: 737752 - protein, 756 aa, Homo sapiens
EHAENCSRPGSLWQRRRRGPGPSNPARARLPQQPPPLPPLGHEPSFLLPPAALPAAAAASRLWASAGNMPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQVHYVLLREKVDSLHLAGLMQ

SEQ ID NO: 737753 - protein, 291 aa, Homo sapiens
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 737754 - protein, 291 aa, Homo sapiens; identical to SEQ ID NO: 737753

SEQ ID NO: 737755 - protein, 291 aa, Homo sapiens; identical to SEQ ID NO: 737753

SEQ ID NO: 737756 - protein, 291 aa, Homo sapiens; identical to SEQ ID NO: 737753

SEQ ID NO: 737757 - protein, 291 aa, Homo sapiens; identical to SEQ ID NO: 737753

SEQ ID NO: 737758 - protein, 211 aa, Homo sapiens
MRISSLTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 737759 - protein, 291 aa, Homo sapiens; identical to SEQ ID NO: 737753

SEQ ID NO: 737760 - protein, 291 aa, Homo sapiens; identical to SEQ ID NO: 737753

SEQ ID NO: 737761 - protein, 182 aa, Homo sapiens
DKKALLRLESILPISHVVLGLESILPIYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 737762 - protein, 291 aa, Homo sapiens; identical to SEQ ID NO: 737753

SEQ ID NO: 737763 - protein, 220 aa, Homo sapiens
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEGWSAMA

SEQ ID NO: 737764 - protein, 183 aa, Homo sapiens
RVFIGNLNTLVVKKSDVEAIFSKYGKIVGCSVHKGFAFFQYVNERNARAAVAGEDGRMIAGQVLDINLLQSQNGFNSKSGQRGSSKSGKLKGDDLQAIKRELTQIKQKVDSFLENLEKIEKEQSKQAVEMNNDKSEEEQSSSSVKKDETNVKMESEGGADDSAEEGDLLDDDDNEDGGMTSWS

SEQ ID NO: 737765 - protein, 231 aa, Homo sapiens
MAVFLEAKDAHSVLKRFPRANEFLEELRQGTIERECMEEICSYEEVKEVFENKEKTMEFWKGYPNAVYSVRDPSQSSDAMYVVVPLLGVALLIVIALFIIWRCQLQKATRHHPSYAQNRYLASRAGHTLPRVMVYRGTVHSQGEPSGHREAASSPQVVLGPSRGGRTTVRLESTLYLPELSLSRLSSTTPPPSYEEVTAPQESSSEEASVSYSDPPPKYEEIVAANPGADK

SEQ ID NO: 737766 - protein, 102 aa, Homo sapiens
MRRKKKNSTLPLDCYFVQERDHGESLSRSRRLCLSRSMCVCCLMCGHSQLRLRWISWQQSCWSRWLFSLTSNEAPFQDFIDSETSTAPHPPPRNSTNTNHYN

SEQ ID NO: 737767 - protein, 162 aa, Homo sapiens
MAVFLEAKDAHSVLKRFPRANEFLEELRQGTIERECMEEICSYEEVKEVFENKEKTMEFWKGYPNAVYSVRDPSQSSDAMYVVVPLLGVALLIVIALFIIWRCQLQKATRHHPSYAQNRRCFAVRLAAPSFASKYSNVGAFPFRLWAASLSLARIYLTNIPK

SEQ ID NO: 737768 - protein, 111 aa, Homo sapiens
MPSASVIANRNRERGPGTGKKRRPGGGSGDHGAPDHSEEDEAERAGAATAHAWPGQCWKDNHPEEVQWGGHRHHLPNAGLQHQDPGAPRIQAEHLGCGWPEVPAVLLAELL

SEQ ID NO: 737769 - protein, 184 aa, Homo sapiens
MGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEERLAGATLLIFANKQDLPGALSSNAIREALELDSIRSHHWCIQGCSAVTGENLLPGIDWLLDDISSRIFTAD

SEQ ID NO: 737770 - protein, 184 aa, Homo sapiens; identical to SEQ ID NO: 737769

SEQ ID NO: 737771 - protein, 184 aa, Homo sapiens; identical to SEQ ID NO: 737769

SEQ ID NO: 737772 - protein, 184 aa, Homo sapiens; identical to SEQ ID NO: 737769

SEQ ID NO: 737773 - protein, 194 aa, Homo sapiens
MGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEEVGSSYPLCTCMDVWLPSQQMPRGARGPRGKPEAGSLPSLGPHHGRPMVPEAGHMLWTEIELTSLWCYYVTTLSISFYALKW

SEQ ID NO: 737774 - protein, 184 aa, Homo sapiens; identical to SEQ ID NO: 737769

SEQ ID NO: 737775 - protein, 164 aa, Homo sapiens [sequence omitted]

SEQ ID NO: 737776 - protein, 157 aa, Homo sapiens [sequence omitted]

SEQ ID NO: 737777 - protein, 88 aa, Homo sapiens
RVAAPSRQPFLVGMVAKRLAGATLLIFANKQDLPGALSSNAIREALELDSIRSHHWCIQGCSAVTGENLLPGIDWLLDDISSRIFTAD

SEQ ID NO: 737778 - protein, 184 aa, Homo sapiens; identical to SEQ ID NO: 737769

SEQ ID NO: 737779 - protein, 80 aa, Homo sapiens
LNRVAALPARLAGATLLIFANKQDLPGALSSNAIREALELDSIRSHHWCIQGCSAVTGENLLPGIDWLLDDISSRIFTAD

SEQ ID NO: 737780 - protein, 130 aa, Homo sapiens
RRRRMASVENMGGEDTQENDGKNTAAGQGSMLNTPQMASERLREALNGRRRGMAGGVEWRLAGATLLIFANKQDLPGALSSNAIREALELDSIRSHHWCIQGCSAVTGENLLPGIDWLLDDISSRIFTAD

SEQ ID NO: 737781 - protein, 75 aa, Homo sapiens
MPELKSCEVGVRKYNANNKRQRVTHHTLRQLCIMSLSRRQGRVIKAKINTHTYTKIKVKSQRGESMSKKHHQGLI

SEQ ID NO: 737782 - protein, 1354 aa, Homo sapiens
PDLVMTVMEAISILLNAKPDWPSAKQLLGDSNFLKRLLEYDKENIKPQILAKLQKYINNPDFVPEKVEKVSKACKSMCMWVRAMDLYSRVVKVVEPKRQKLRAAQAELDITMATLREKQALLRQVEDQIQALQDEYDKGVNEKESLAKTMALTKARLVRAGKLTAALEDEQVRWEESIQKFEEEISNITGNVFIAAACVAYYGAFTAQYRQSLIECWIQDCQSLEIPIDPSFSLINILGDPYEIRQWNTDGLPRDLISTENGILVTQGRRWPLMIDPQDQANRWIRNKESKSGLKIIKLTDSNFLRILENSIRLGLPVLLEELKETLDPALEPILLKQIFISGGRLLIRLGDSDIDYDKNFRFYMTTKMPNPHYLPEVCIKVTIINFTVTKSGLEDQLLSDVVRLEKPRLEEQRIKLIVRINTDKNQLKTIEEKILRMLFTSEGNILDNEELIDTLQDSKITSGAIKTRLEEAESTEQMINVAREKYRPVATQGSVMYFVIASLSEIDPMYQYSLKYFKQLFNTTIETSVKTENLQQRLDVLLEQTLLTAYVNVSRGLFEQHKLIYSFMLCVEMMRQQGTLSDAEWNFFLRGSAGLEKERPPKPEAPWLPTATWFACCDLEESFPVFHGLTQNILSHPISIRLGSFETYINPQKWEGYSKMKHEDKHMRQEKEAAHQDPWSAGLSSFHKLILIKCCKEEKVVFALTDFVIENLGKQFIETPPVDLPTLYQDMSCNTPLVFILSTGSDPMGAFQRFARESGYSERVQSISLGQGQGPIAEKMVKDAMKSGNWVFLQNCHLAVSWMLAMEELIKTFTDPDSAIKDTFRLFLSSMPSNTFPVTVLQNSVKVTNEPPKGLRANIRRAFTEMTPSFFEENILGKKWRQIIFGICFFHAIIQERKKFGPLGWNICYEFNDSDRECALLNLKLYCKEGKIPWDALIYITGEITYGGRVTDSWDQRCLRTILKRFFSPETLEEDYKYSESGIYFAPMADSLQEFKDYIENLPLIDDPEIFGMHENANLVFQYKETSTLINTILEVQPRSSTGGEGKSNDEIVQELVASVQTRVPEKLEMEGASESLFVKDLQGRLNSLTTVLGQEVDRFNNLLKLIHTSLETLNKAIAGFVVMSEEMEKVYNSFLNNQVPALWSNTAYPSLKPLGSWVKDLILRTSFVDLWLKRGQPKSYWISGFFFPQGFLTGTLQNHARKYNLPIDELSFKYSVIPTYRDQAAVIEAAKTVQFGQELPMDMELPSPEDGVLVHGMFMDASRWDDKEMVIEDALPGQMNPVLPVVHFEPQQNYKPSPTLYHCPLYKTGARAGTLSTTGHSTNFVVTVLLPSKRSKDYWIAKGSALLCQLSE

SEQ ID NO: 737783 - protein, 644 aa, Homo sapiens
HWQRHNLDDLNFGFSDVVRLEKPRLEEQRIKLIVRINTDKNQLKTIEEKILRMLFTSEGNILDNEELIDTLQDSKITSGAIKTRLEEAESTEQMINVAREKYRPVATQGSVMYFVIASLSEIDPMYQYSLKYFKQLFNTTIETSVKTENLQQRLDVLLEQTLLTAYVNVSRGLFEQHKLIYSFMLCVEMMRQQGTLSDAEWNFFLRGSAGLEKERPPKPEAPWLPTATWFACCDLEESFPVFHGLTQNILSHPISIRLGSFETYINPQKWEGYSKMKHEDKHMRQEKEAAHQDPWSAGLSSFHKLILIKCCKEEKVVFALTDFVIENLGKQFIETPPVDLPTLYQDMSCNTPLVFILSTGSDPMGAFQRFARESGYSERVQSISLGQGQGPIAEKMVKDAMKSGNWVFLQNCHLAVSWMLAMEELIKTFTDPDSAIKDTFRLFLSSMPSNTFPVTVLQNSVKVTNEPPKGLRANIRRAFTEMTPSFFEENILGKKWRQIIFGICFFHAIIQERKKFGPLGWNICYEFNDSDRECALLNLKLYCKEGKIPWDALIYITGEITYGGRVTDSWDQRCLRTILKRFFSPETLEEDYKYSESGIYFAPMADSLQEFKDYIENLPLIDDPEIFGMHENANLVFQVCGLSS

SEQ ID NO: 737784 - protein, 590 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 737785 - protein, 512 aa, Homo sapiens [sequence omitted]

SEQ ID NO: 737786 - protein, 590 aa, Homo sapiens; identical to SEQ ID NO: 737784

SEQ ID NO: 737787 - protein, 590 aa, Homo sapiens; identical to SEQ ID NO: 737784

SEQ ID NO: 737788 - protein, 590 aa, Homo sapiens; identical to SEQ ID NO: 737784

SEQ ID NO: 737789 - protein, 590 aa, Homo sapiens; identical to SEQ ID NO: 737784

SEQ ID NO: 737790 - protein, 590 aa, Homo sapiens; identical to SEQ ID NO: 737784

SEQ ID NO: 737791 - protein, 561 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDRIHLQELLQYKRQNPAQFCVRVCSGCAVLAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 737792 - protein, 336 aa, Homo sapiens
MISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 737793 - protein, 336 aa, Homo sapiens; identical to SEQ ID NO: 737792

SEQ ID NO: 737794 - protein, 506 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 737795 - protein, 528 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQQEAQAVAEP

SEQ ID NO: 737796 - protein, 590 aa, Homo sapiens; identical to SEQ ID NO: 737784

SEQ ID NO: 737797 - protein, 135 aa, Homo sapiens
AGTVPSLRSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 737798 - protein, 590 aa, Homo sapiens; identical to SEQ ID NO: 737784

SEQ ID NO: 737799 - protein, 217 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFHS

SEQ ID NO: 737800 - protein, 590 aa, Homo sapiens; identical to SEQ ID NO: 737784

SEQ ID NO: 737801 - protein, 118 aa, Homo sapiens
MVAIPPSACLPACCPGHGAVPVPRIGFKFVNNFPFGLVDVNRAREVLPTACACLPASSLFSFHYAPSPGGLALSFSSYPQGPVLLCPHVPLGCLVEALYNFSLVLCSFLLYFPAVSCP

SEQ ID NO: 737802 - protein, 263 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGIMISYIVSCP

SEQ ID NO: 737803 - protein, 235 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFHMCSLLRLGASLLLLWVIQV

SEQ ID NO: 737804 - protein, 128 aa, Homo sapiens
LCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFW

SEQ ID NO: 737805 - protein, 578 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQEALTTEDFELLDQGELEQLNAELGLEPETPPKPPDAPPLGPDIHSLVQSDQEAQAVAEP

SEQ ID NO: 737806 - protein, 590 aa, Homo sapiens; identical to SEQ ID NO: 737784

SEQ ID NO: 737807 - protein, 235 aa, Homo sapiens
SSSSSMSLAKGVDFSRLLKPLYSHSHFPYSVDMYMCMVARVPPPEYLSHDGFFRGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 737808 - protein, 291 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLLEVTQPPPLPFSHLFPRTHPSPCLPLRKKRHSPLRTLSCWIRGSWSS

SEQ ID NO: 737809 - protein, 146 aa, Homo sapiens
PSWGDPAPLKCVFTKWSEMLHWSSRGAFHSILGGPCPIETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 737810 - protein, 278 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGRLLVWEVKSKPGAVGQASSYTLRSL

SEQ ID NO: 737811 - protein, 421 aa, Homo sapiens
RAQLRSHVTLVRNLCCPPRRPLPPDAPPAAAAQPWLLAGSGGGCGGAMASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEEGHAGSSESPQA

SEQ ID NO: 737812 - protein, 75 aa, Homo sapiens
MGELTDALLGKGALKTRFGSLLGQGDWGGVRVSQVEVRWVIFCLLHWLHVNLPVTEYLALDVLFPLAIVQKHSIL

SEQ ID NO: 737813 - protein, 35 aa, Homo sapiens
MQPTNFHGITRQPRTIKCLRKTNHYQKGAPKVSRY

SEQ ID NO: 737814 - protein, 135 aa, Homo sapiens
LYISKTSIDWGCFELMGLVLKQHYFVQNKIVESMPLRRDTSQGLKCRVTPPFGNEPLLVSGLDGTSPAFRFLFYKTGVITAPTSEGYHEDCHRGCRVPGPPAWYGGTHSVKAICCHCHCHSYCRHSVACQFQNWG

SEQ ID NO: 737815 - protein, 198 aa, Homo sapiens [sequence omitted]

SEQ ID NO: 737816 - protein, 344 aa, Homo sapiens
PPTRPAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQGDDQLNVFGEDTMGGFMEDLRKCKIIFIIGGPGSGKGTQCEKLVEKYGFTHLSTGELLREELASESERSKLIRDIMERGDLVPSGIVLELLKEAMVASLGDTRGFLIDGYPREVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIIF

SEQ ID NO: 737817 - protein, 125 aa, Homo sapiens
TLKEPEGQERKKPEALGLSQNISRVRFLTVLCSHSHLQIGDPQLVICMDCSADTMTNRLLQRSRSSLPVDDTTKTIAKRLEAYYRASIPVIAYYETKTQLHKINAEGTPEDVFLQLCTAIDSIIF

SEQ ID NO: 737818 - protein, 177 aa, Homo sapiens
MNTNDAKEYLARREIPQLFESLLNGLMCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRTEDPQYQQQ

SEQ ID NO: 737819 - protein, 151 aa, Homo sapiens
MCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRTEDPQYQQQ

SEQ ID NO: 737820 - protein, 344 aa, Homo sapiens; identical to SEQ ID NO: 737816

SEQ ID NO: 737821 - protein, 134 aa, Homo sapiens
LTTLALLQGIVLELLKEAMVASLGDTRGFLIDGYPREVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIIF

SEQ ID NO: 737822 - protein, 146 aa, Homo sapiens
CVRHAVLPPPLPAPHPWRPRCLAAREAAAQLLGACSSGSGAGTEAGAAGVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIIF

SEQ ID NO: 737823 - protein, 344 aa, Homo sapiens; identical to SEQ ID NO: 737816

SEQ ID NO: 737824 - protein, 344 aa, Homo sapiens; identical to SEQ ID NO: 737816

SEQ ID NO: 737825 - protein, 177 aa, Homo sapiens; identical to SEQ ID NO: 737818

SEQ ID NO: 737826 - protein, 344 aa, Homo sapiens; identical to SEQ ID NO: 737816

SEQ ID NO: 737827 - protein, 153 aa, Homo sapiens
MNTNDAKEYLARREIPQLFESLLNGLMCSKPEDPVEYLESCLQKVKELGGCDKVKWDTFVSQEKKTLPPLNGGQSRRSFLRNESDTDLSETAELIEEYEVFDPTRPRPKIILVIGGPGSGKGTQSLKIAERYGFQYISVGELLRTEDPQYQQQ

SEQ ID NO: 737828 - protein, 138 aa, Homo sapiens
PPTRPAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQVIKI

SEQ ID NO: 737829 - protein, 168 aa, Homo sapiens
PPTRPAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQGDDQLNVFGEDTMGGFTPVLPFMLKTQLKESSKD

SEQ ID NO: 737830 - protein, 103 aa, Homo sapiens
LWQRDMGWKMASPTDGTDLEASLLSFEKLDRASPDLWPEQLPGVAEFAASFKSPITSSPPKWMAEIERDDIDMLKELGSLTTANLMEKVRGLQNLAYQLGLDE

SEQ ID NO: 737831 - protein, 121 aa, Homo sapiens
LWQRDMGWKMASPTDGTDLEASLLSFEKLDRASPDLWPEQLPGVAEFAASFKSPITSSPPKWMAEIERDDIDMLKELGSLTTANLMEKVRGLQNLAYQLGLDESREMTRGKFLNILEKPKK

SEQ ID NO: 737832 - protein, 121 aa, Homo sapiens; identical to SEQ ID NO: 737831

SEQ ID NO: 737833 - protein, 121 aa, Homo sapiens; identical to SEQ ID NO: 737831

SEQ ID NO: 737834 - protein, 121 aa, Homo sapiens; identical to SEQ ID NO: 737831

SEQ ID NO: 737835 - protein, 156 aa, Homo sapiens
LWQRDMGWKMASPTDGTDLEASLLSFEKLDRASPDLWPEQLPGVAEFAASFKSPITSSPPKWMAEIERDDIDMLKELGSLTTANLMEKVRGLQNLAYQLGLDEWSPSVTQAGVQWCDLGSLQPLPPGLKQVPHLSFPSSWDYRCEPQRPARNAFLI

SEQ ID NO: 737836 - protein, 103 aa, Homo sapiens
MQPCSPSSVAGCRKGGFTAQTRGGPWAEGRRQSSARCLGPGQQRPLLAALELHSLLAFPWASFLGTRLLPMVEHQGSVRLPVSPTHSASRVPVPTSEPWFCLH

SEQ ID NO: 737837 - protein, 31 aa, Homo sapiens
MVTSLSLRARYRIQSLGHVDTELRRIFSEIP

SEQ ID NO: 737838 - protein, 107 aa, Homo sapiens [sequence omitted]

SEQ ID NO: 737839 - protein, 139 aa, Homo sapiens [sequence omitted]

SEQ ID NO: 737840 - protein, 127 aa, Homo sapiens
MHICYLYIFFGKVSVKIFSLFKIGFFFIVEFKEFFVYFGYMSSIRYMLCSIFSQCVACLFILLTMSFAEQKFLILMMSSLSVFSFMSHAFGVVSKNSMLDHGHLDFLVCYLLEVLCFAFYIYVCDPF

SEQ ID NO: 737841 - protein, 319 aa, Homo sapiens
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPVHLGFFLQFLVRNSFIVECRAKQSISFFLQLSMCFSNVNCCLDVFCYYFVIKEFRMNIRAHRPSRVQLVLQDTTISRG

SEQ ID NO: 737842 - protein, 71 aa, Homo sapiens
LAVVTSLVKAPRSGARVGISGRGLSGGGKVANQDFCNTKISHAVSSSSQEVWLGLAGSLGLEPGEKSQKNC

SEQ ID NO: 737843 - protein, 129 aa, Homo sapiens
LSEPSLRRFPHEPSRATSRRIYSPGSAKGSLHQAHNSSSKRMFKGPVISASAGQQNFACRILELRRVLNQGQWRKWETVKRVRGLCQLPPFPPPAIHLTFLSLTFVIMRMCIFINNHLFLQCKILLLQK

SEQ ID NO: 737844 - protein, 242 aa, Homo sapiens
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFCSLTETKRRMLRGSSSGCGAPRMFPKTSRR

SEQ ID NO: 737845 - protein, 148 aa, Homo sapiens
MLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFCSLTETKRRMLRGSSSGCGAPRMFPKTSRR

SEQ ID NO: 737846 - protein, 188 aa, Homo sapiens
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQSSSGCGAPRMFPKTSRR

SEQ ID NO: 737847 - protein, 242 aa, Homo sapiens; identical to SEQ ID NO: 737844

SEQ ID NO: 737848 - protein, 265 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFCSLTETKRRMLRGSSSGCGAPRMFPKTSRR

SEQ ID NO: 737849 - protein, 242 aa, Homo sapiens; identical to SEQ ID NO: 737844

SEQ ID NO: 737850 - protein, 265 aa, Homo sapiens; identical to SEQ ID NO: 737848

SEQ ID NO: 737851 - protein, 125 aa, Homo sapiens [sequence omitted]

SEQ ID NO: 737852 - protein, 520 aa, Homo sapiens
AGTVREFGIQCLAMARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRFGFWPEIPHHTAWYSPCVSLGRRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 737853 - protein, 499 aa, Homo sapiens
SPCHPVLTPSGQCLAMARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 737854 - protein, 522 aa, Homo sapiens
SPCHPVLTPSGQCLAMARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRFGFWPEIPHHTAWYSPCVSLGRRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 737855 - protein, 299 aa, Homo sapiens
GWYRREFGIQCLAMARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQVQWGSLARPEDGPSTPWHTCGCLPATHGTLGLLPPVGCLPLGVWSGCWGDTRGVWSGDVARSETQVCSGLSTCPNQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFR

SEQ ID NO: 737856 - protein, 77 aa, Homo sapiens
KKRLKAVTGSSHREVLVTLLRLTPRSAGWMQKGREEDSVTETVNASYSPKTAAEKEGQMEGQVRSRKVLNYAAIFKN

SEQ ID NO: 737857 - protein, 115 aa, Homo sapiens
QKNEGLCDILFPEGEEGRPPNDLAPWNLASLLRGTYSAVLHCGSRVWLGLALSSDSPLGQNHTSKNGLSQSQVSLLWNSIPGFPEQLGTPFCNQTEFTFGHQLLPQTKGRTKYRK

SEQ ID NO: 737858 - protein, 1486 aa, Homo sapiens
MAANVGSMFQYWKRFDLRRLQKELNSVASELSARQEESEHSHKHLIELRREFKKNVPEEIREMVAPVLKSFQAEVVALSKRSQEAEAAFLSVYKQLIEAPDPVPVFEAARSLDDRLQPPSFDPSGQPRRDLHTSWKRNPELLSPKEQREGTSPAGPTLTEGSRLPGIPGKALLTETLLQRNEAEKQKGLQEVQITLAARLGEAEEKIKVLHSALKATQAELLELRRKYDEEAASKADEVGLIMTNLEKANQRAEAAQREVESLREQLASVNSSIRLACCSPQGPSGDKVNFTLCSGPRLEAALASKDREILRLLKDVQHLQSSLQELEEASANQIADLERQLTAKSEAIEKLEEKLQAQSDYEEIKTELSILKAMKLASSTCSLPQGMAKPEDSLLIAKEAFFPTQKFLLEKPSLLASPEEDPSEDDSIKDSLGTEQSYPSPQQLPPPPGPEDPLSPSPGQPLLGPSLGPDGTRTFSLSPFPSLASGERLMMPPAAFKGEAGGLLVFPPAFYGAKPPTAPATPAPGPEPLGGPEPADGGGGGAAGPGAEEEQLDTAEIAFQVKEQLLKHNIGQRVFGHYVLGLSQGSVSEILARPKPWRKLTVKGKEPFIKMKQFLSDEQNVLALRTIQVRQRGSITPRIRTPETGSDDAIKSILEQAKKEIESQKGGEPKTSVAPLSIANGTTPASTSEDAIKSILEQARREMQAQQQALLEMEVAPRGRSVPPSPPERPSLATASQNGAPALVKQEEGSGGPAQAPLPVLSPAAFVQSIIRKVKSEIGDAGYFDHHWASDRGLLSRPYASVSPSLSSSSSSGYSGQPNGRAWPRGDEAPVPPEDEAAAGAEDEPPRTGELKAEGATAEAGARLPYYPAYVPRTLKPTVPPLTPEQYELYMYREVDTLELTRQVKEKLAKNGICQRIFGEKVLGLSQGSVSDMLSRPKPWSKLTQKGREPFIRMQLWLSDQLGQAVGQQPGASQASPTEPRSSPSPPPSPTEPEKSSQEPLSLSLESSKENQQPEGRSSSSLSGKMYSGSQAPGGIQEIVAMSPELDTYSITKRVKEVLTDNNLGQRLFGESILGLTQGSVSDLLSRPKPWHKLSLKGREPFVRMQLWLNDPHNVEKLRDMKKLEKKAYLKRRYGLISTGSDSESPATRSECPSPCLQPQDLSLLQIKKPRVVLAPEEKEALRKAYQLEPYPSQQTIELLSFQLNLKTNTVINWFHNYRSRMRREMLVEGTQDEPDLDPSGGPGILPPGHSHPDPTPQSPDSETEDQKPTVKELELQEGPEENSTPLTTQDKAQVRIKQEQMEEDAEEEAGSQPQDSGELDKGQGPPKEEHPDPPGNDGLPKVAPGPLLPGGSTPDCPSLHPQQESEAGERLHPDPLSFKSASESSRCSLEVSLNSPSAASSPGLMMSVSPVPSSSAPISPSPPGAPPAKVPSASPTADMAGALHPSAKVNPNLQRRHEKMANLNNIIYRLERAANREEALEWEF

SEQ ID NO: 737859 - protein, 103 aa, Homo sapiens
AQYLPPRPQSTPEWSTGAPPPLVHLSKSRPCFMASRGSHRSSPRPIGPYSLQPQTSGLKQSSCLSLPSPANFLNLFFVVPKSHYVTQTGLKLLASSDPPTSAS

SEQ ID NO: 737860 - protein, 1546 aa, Homo sapiens
MCSPHMGEQDWTCRDPGWEQNLRQLRVLWEGNGFIAAFRFYFCTFAFYLPVVLLTGPRSGAVSGHFWEPWTALERRQELPRKELNSVASELSARQEESEHSHKHLIELRREFKKNVPEEIREMVAPVLKSFQAEVVALSKRSQEAEAAFLSVYKQLIEAPDPVPVFEAARSLDDRLQPPSFDPSGQPRRDLHTSWKRNPELLSPKEQREGTSPAGPTLTEGSRLPGIPGKALLTETLLQRNEAEKQKGLQEVQITLAARLGEAEEKIKVLHSALKATQAELLELRRKYDEEAASKADEVGLIMTNLEKANQRAEAAQREVESLREQLASVNSSIRLACCSPQGPSGDKVNFTLCSGPRLEAALASKDREILRLLKDVQHLQSSLQELEEASANQIADLERQLTAKSEAIEKLEEKLQAQSDYEEIKTELSILKAMKLASSTCSLPQGMAKPEDSLLIAKEAFFPTQKFLLEKPSLLASPEEDPSEDDSIKDSLGTEQSYPSPQQLPPPPGPEDPLSPSPGQPLLGPSLGPDGTRTFSLSPFPSLASGERLMMPPAAFKGEAGGLLVFPPAFYGAKPPTAPATPAPGPEPLGGPEPADGGGGGAAGPGAEEEQLDTAEIAFQVKEQLLKHNIGQRVFGHYVLGLSQGSVSEILARPKPWRKLTVKGKEPFIKMKQFLSDEQNVLALRTIQVRQRGSITPRIRTPETGSDDAIKSILEQAKKEIESQKGGEPKTSVAPLSIANGTTPASTSEDAIKSILEQARREMQAQQQALLEMEVAPRGRSVPPSPPERPSLATASQNGAPALVKQEEGSGGPAQAPLPVLSPAAFVQSIIRKVKSEIGDAGYFDHHWASDRGLLSRPYASVSPSLSSSSSSGYSGQPNGRAWPRGDEAPVPPEDEAAAGAEDEPPRTGELKAEGATAEAGARLPYYPAYVPRTLKPTVPPLTPEQYELYMYREVDTLELTRQVKEKLAKNGICQRIFGEKVLGLSQGSVSDMLSRPKPWSKLTQKGREPFIRMQLWLSDQLGQAVGQQPGASQASPTEPRSSPSPPPSPTEPEKSSQEPLSLSLESSKENQQPEGRSSSSLSGKMYSGSQAPGGIQEIVAMSPELDTYSITKRVKEVLTDNNLGQRLFGESILGLTQGSVSDLLSRPKPWHKLSLKGREPFVRMQLWLNDPHNVEKLRDMKKLEKKAYLKRRYGLISTGSDSESPATRSECPSPCLQPQDLSLLQIKKPRVVLAPEEKEALRKAYQLEPYPSQQTIELLSFQLNLKTNTVINWFHNYRSRMRREMLVEGTQDEPDLDPSGGPGILPPGHSHPDPTPQSPDSETEDQKPTVKELELQEGPEENSTPLTTQDKAQVRIKQEQMEEDAEEEAGSQPQDSGELDKGQGPPKEEHPDPPGNDGLPKVAPGPLLPGGSTPDCPSLHPQQESEAGERLHPDPLSFKSASESSRCSLEVSLNSPSAASSPGLMMSVSPVPSSSAPISPSPPGAPPAKVPSASPTADMAGALHPSAKVNPNLQRRHEKMANLNNIIYRLERAANREEALEWEF

SEQ ID NO: 737861 - protein, 1112 aa, Homo sapiens
MKLASSTCSLPQGMAKPEDSLLIAKEAFFPTQKFLLEKPSLLASPEEDPSEDDSIKDSLGTEQSYPSPQQLPPPPGPEDPLSPSPGQPLLGPSLGPDGTRTFSLSPFPSLASGERLMMPPAAFKGEAGGLLVFPPAFYGAKPPTAPATPAPGPEPLGGPEPADGGGGGAAGPGAEEEQLDTAEIAFQVKEQLLKHNIGQRVFGHYVLGLSQGSVSEILARPKPWRKLTVKGKEPFIKMKQFLSDEQNVLALRTIQVRQRGSITPRIRTPETGSDDAIKSILEQAKKEIESQKGGEPKTSVAPLSIANGTTPASTSEDAIKSILEQARREMQAQQQALLEMEVAPRGRSVPPSPPERPSLATASQNGAPALVKQEEGSGGPAQAPLPVLSPAAFVQSIIRKVKSEIGDAGYFDHHWASDRGLLSRPYASVSPSLSSSSSSGYSGQPNGRAWPRGDEAPVPPEDEAAAGAEDEPPRTGELKAEGATAEAGARLPYYPAYVPRTLKPTVPPLTPEQYELYMYREVDTLELTRQVKEKLAKNGICQRIFGEKVLGLSQGSVSDMLSRPKPWSKLTQKGREPFIRMQLWLSDQLGQAVGQQPGASQASPTEPRSSPSPPPSPTEPEKSSQEPLSLSLESSKENQQPEGRSSSSLSGKMYSGSQAPGGIQEIVAMSPELDTYSITKRVKEVLTDNNLGQRLFGESILGLTQGSVSDLLSRPKPWHKLSLKGREPFVRMQLWLNDPHNVEKLRDMKKLEKKAYLKRRYGLISTGSDSESPATRSECPSPCLQPQDLSLLQIKKPRVVLAPEEKEALRKAYQLEPYPSQQTIELLSFQLNLKTNTVINWFHNYRSRMRREMLVEGTQDEPDLDPSGGPGILPPGHSHPDPTPQSPDSETEDQKPTVKELELQEGPEENSTPLTTQDKAQVRIKQEQMEEDAEEEAGSQPQDSGELDKGQGPPKEEHPDPPGNDGLPKVAPGPLLPGGSTPDCPSLHPQQESEAGERLHPDPLSFKSASESSRCSLEVSLNSPSAASSPGLMMSVSPVPSSSAPISPSPPGAPPAKVPSASPTADMAGALHPSAKVNPNLQRRHEKMANLNNIIYRLERAANREEALEWEF

SEQ ID NO: 737862 - protein, 1156 aa, Homo sapiens
MVRVCTYSRRYQGTVSEAIEKLEEKLQAQSDYEEIKTELSILKAMKLASSTCSLPQGMAKPEDSLLIAKEAFFPTQKFLLEKPSLLASPEEDPSEDDSIKDSLGTEQSYPSPQQLPPPPGPEDPLSPSPGQPLLGPSLGPDGTRTFSLSPFPSLASGERLMMPPAAFKGEAGGLLVFPPAFYGAKPPTAPATPAPGPEPLGGPEPADGGGGGAAGPGAEEEQLDTAEIAFQVKEQLLKHNIGQRVFGHYVLGLSQGSVSEILARPKPWRKLTVKGKEPFIKMKQFLSDEQNVLALRTIQVRQRGSITPRIRTPETGSDDAIKSILEQAKKEIESQKGGEPKTSVAPLSIANGTTPASTSEDAIKSILEQARREMQAQQQALLEMEVAPRGRSVPPSPPERPSLATASQNGAPALVKQEEGSGGPAQAPLPVLSPAAFVQSIIRKVKSEIGDAGYFDHHWASDRGLLSRPYASVSPSLSSSSSSGYSGQPNGRAWPRGDEAPVPPEDEAAAGAEDEPPRTGELKAEGATAEAGARLPYYPAYVPRTLKPTVPPLTPEQYELYMYREVDTLELTRQVKEKLAKNGICQRIFGEKVLGLSQGSVSDMLSRPKPWSKLTQKGREPFIRMQLWLSDQLGQAVGQQPGASQASPTEPRSSPSPPPSPTEPEKSSQEPLSLSLESSKENQQPEGRSSSSLSGKMYSGSQAPGGIQEIVAMSPELDTYSITKRVKEVLTDNNLGQRLFGESILGLTQGSVSDLLSRPKPWHKLSLKGREPFVRMQLWLNDPHNVEKLRDMKKLEKKAYLKRRYGLISTGSDSESPATRSECPSPCLQPQDLSLLQIKKPRVVLAPEEKEALRKAYQLEPYPSQQTIELLSFQLNLKTNTVINWFHNYRSRMRREMLVEGTQDEPDLDPSGGPGILPPGHSHPDPTPQSPDSETEDQKPTVKELELQEGPEENSTPLTTQDKAQVRIKQEQMEEDAEEEAGSQPQDSGELDKGQGPPKEEHPDPPGNDGLPKVAPGPLLPGGSTPDCPSLHPQQESEAGERLHPDPLSFKSASESSRCSLEVSLNSPSAASSPGLMMSVSPVPSSSAPISPSPPGAPPAKVPSASPTADMAGALHPSAKVNPNLQRRHEKMANLNNIIYRLERAANREEALEWEF

SEQ ID NO: 737863 - protein, 124 aa, Homo sapiens
MAANVGSMFQYWKRFDLRRLQKELNSVASELSARQEESEHSHKHLIELRREFKKNVPEEIREMVAPVLKSFQAEVVALSKRSQEAEAAFLSVYKQLIEAPGKLFVEILLPATRSHTSPDSTFLF

SEQ ID NO: 737864 - protein, 48 aa, Homo sapiens
MVCHGPGGLGTAWRAARLAEATLEEAAAFPAWGSSRAWVRGVSRRDPS

SEQ ID NO: 737865 - protein, 407 aa, Homo sapiens
MLLSVTSRPGISTFGYNRNNKKPYVSLAQQMAPPSPSNSTPNSSSGSNGNDQLSKTNLYIRGLQPGTTDQDLVKLCQPYGKIVSTKAILDKTTNKCKGYGFVDFDSPSAAQKAVTALKASGVQAQMAKQQEQDPTNLYISNLPLSMDEQELEGMLKPFGQVISTRILRDTSGTSRGVGFARMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQRVTQTSPLQVPNPSWMHHHSYLMQPSGSVLTPGMDHPISLQPASMMGPLTQQLGHLSLSSTGTYMPTAAAMQGAYISQYTPVPSSSVSVEESSGQQNQVAVDAPSEHGVYSFQFNK

SEQ ID NO: 737866 - protein, 136 aa, Homo sapiens
MALSQKEANDSDVQPSGAQRAEAFVRAFLKRSTPRMSPQAREDQMQRKGGVLEYFTRHKRKEKKKAKASLARQGEEVRLFCIEPEPPRVQAFSLSSWTLENSHIRTCAEGLKAETPAHDELRASSFGELYGAIYLG

SEQ ID NO: 737867 - protein, 282 aa, Homo sapiens
MAKQQEQDPTNLYISNLPLSMDEQELEGMLKPFGQVISTRILRDTSGTSRGVGFARMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQRVTQTSPLQVPNPSWMHHHSYLMQPSGSVLTPGMDHPISLQPASMMGPLTQQLGHLSLSSTGTYMPTAAAMQGAYISQYTPVPSSSVSVEESSGQQNQVAVDAPSEHGVYSFQFNK

SEQ ID NO: 737868 - protein, 226 aa, Homo sapiens [sequence omitted]

SEQ ID NO: 737869 - protein, 282 aa, Homo sapiens; identical to SEQ ID NO: 737867

SEQ ID NO: 737870 - protein, 407 aa, Homo sapiens; identical to SEQ ID NO: 737865

SEQ ID NO: 737871 - protein, 437 aa, Homo sapiens
MLLSVTSRPGISTFGYNRNNKKPYVSLAQQMAPPSPSNSTPNSSSGSNGNDQLSKTNLYIRGLQPGTTDQDLVKLCQPYGKIVSTKAILDKTTNKCKGYGFVDFDSPSAAQKAVTALKASGVQAQMAKQQEQDPTNLYISNLPLSMDEQELEGMLKPFGQVISTRILRDTSGTSRGVGFARMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQRVTQTSPLQVPNPSWMHHHSYLMQPSGSVLTPGMDHPISLQPASMMGPLTQQLGHLSLSSTGTYMPTAAAMQGAYISQYTPVPSSSVSVEVRVLSFLWIEIRKMNGGRFPPDQDLSLTMMLILCSQIAGRYTKNVGRMCSLRQHAY

SEQ ID NO: 737872 - protein, 102 aa, Homo sapiens [sequence omitted]

SEQ ID NO: 737873 - protein, 896 aa, Homo sapiens
MNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 737874 - protein, 124 aa, Homo sapiens [sequence omitted]

SEQ ID NO: 737875 - protein, 918 aa, Homo sapiens
QSSRRLPSAARWPGAEPLWSQTMNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 737876 - protein, 933 aa, Homo sapiens
MFYLEDDKEDEVVCKGSLSKTQDVYHDKSPPGILSQTMNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 737877 - protein, 580 aa, Homo sapiens
MEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 737878 - protein, 918 aa, Homo sapiens; identical to SEQ ID NO: 737875

SEQ ID NO: 737879 - protein, 295 aa, Homo sapiens
MKTSPLTLGRRKRESVAVSYLRTHTSGARETPLSEAPQWVRLHGMALQLLEAVIKSPFKSVPPPISYWQLIVNQIGKRCMCLIPDSFSCFYRLLRSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 737880 - protein, 157 aa, Homo sapiens [sequence omitted]

SEQ ID NO: 737881 - protein, 918 aa, Homo sapiens; identical to SEQ ID NO: 737875

SEQ ID NO: 737882 - protein, 918 aa, Homo sapiens; identical to SEQ ID NO: 737875

SEQ ID NO: 737883 - protein, 863 aa, Homo sapiens
QSSRRLPSAARWPGAEPLWSQTMNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHRYLSGRQPSAHRPSMWAGLGPRWGDVWEQKSDVGAATPLPVLWSLVVSYHILLTCHVAGLVKKGRF

SEQ ID NO: 737884 - protein, 424 aa, Homo sapiens
QSSRRLPSAARWPGAEPLWSQTMNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKSQRTTQDELPVLR

SEQ ID NO: 737885 - protein, 112 aa, Homo sapiens
MFYLEDDKEDEVVCKGSLSKTQDVYHDKSPPGILSQTMNYVGQLAGQVIVTVKELYKGINQATLSGCIDVIVVQQQDGSYQCSPFHVRFGKLGVLRSKEKVVSVLKERKSHP

SEQ ID NO: 737886 - protein, 122 aa, Homo sapiens
GVFSFRNGYKFLYCSARAIGMADMTRGYLHWVNDKGTILPRGPLMLSPSSLFSAFHRYLSGRQPSAHRPSMWAGLGPRWGDVWEQKSDVGAATPLPVLWSLVVSYHILLTCHVAGLVKKGRF

SEQ ID NO: 737887 - protein, 171 aa, Homo sapiens
AEKATPLAPKGAAPGAVQPVAGAEAAPAATLAALGGRRPGPPEEPPRELESVPSKLGEPPPLGEGGGGGGEGGGAGGGSGEREGGAPQPPPPRGWRGKGVRAQQRGGSGGEGASPSPSSSSAGKTPGTGSRNSGSGVAGGGSGGGGSYWKEGCLQSELIQFHLKKERAAAA

SEQ ID NO: 737888 - protein, 111 aa, Homo sapiens
MKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGSHPAKHSM

SEQ ID NO: 737889 - protein, 150 aa, Homo sapiens
AECHELMWKFSQMMMIERRKQQNNMFSVTSFTYERERDRKAVGFVVLMKMPPTLSLALSLPAFPPGSRCSTLFLQASLRASILARDCAAAAAIVFLVDRFLYGLDVSGKLLQVAKGLHKLQPATPIAPQVVIRQARISVNSGSHPAKHSM

SEQ ID NO: 737890 - protein, 111 aa, Homo sapiens
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLVGRATPPVPLISPSEAFRL

SEQ ID NO: 737891 - protein, 1244 aa, Homo sapiens [sequence omitted]

SEQ ID NO: 737892 - protein, 1244 aa, Homo sapiens [sequence omitted]

SEQ ID NO: 737893 - protein, 1100 aa, Homo sapiens
MFKANCVAFGCCFSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVNIRGTCLLSYSSSNDCPPELKNLHLCEAKEAFEIGLLTKRDDEPVTGKQELHSFVKAAFGLTTVHRRLHGETGTVHAASQLCKEAMGKLYNFSTSSRSQDREALSQEVMSVIAQVKEHLQVQSFSNVDDRSYVPESFECRLDKLILHGQGDFQKILDTYSQHHTSVCEVFESDCGNNKNEQKDAKTGVCITALKTEIKNIDTVSTTQEKPHCQRDTGISSSLMGKNVQRELRRGGRRNWTHSDAFRVSLDQDVETETEPSDYSNDEGAVFNKSLSGSQTSSAWSNLSGFSSSASWEEVNYHVDDRSARKEPGKEHLVDTQCSTALSEELENDREGRAMHSLRSQLHDLSLQEPNNDNLEPSQNQPQQQMPLTPFSPHNTPGIFLAPGAGLLEGAPEGIQEVRNMGPRNTSAHSRPSYRSASWSSDSGRPKNIGTHPSVQKEEAFEIIVEFPETNCDVKDRQGKEQGEEISERGAGPTFKASPSWVDPEGETAESTEDAPLDFHRVLHNSLGNISMLPCSSFTPNWPVQNPDSRKSGGPVAEQGIDPDASTVDEEGQLLDSMDVPCTNGHGSHRLCILRQPPGQRAETPNSSVSGNILFPVLSEDCTTTEEGNQPGNMLNCSQNSSSSSVWWLKSPAFSSGSSEGDSPWSYLNSSGSSWVSLPGKMRKEILEARTLQPDDFEKLLAGVRHDWLFQRLENTGVFKPSQLHRAHSALLLKYSKKSELWTAQETIVYLGDYLTVKKKGRQRNAFWVHHLHQEEILGRYVGKDYKEQKGLWHHFTDVERQMTAQHYVTEFNKRLYEQNIPTQIFYIPSTILLILEDKTIKGCISVEPYILGEFVKLSNNTKVVKTEYKATEYGLAYGHFSYEFSNHRDVVVDLQGWVTGNGKGLIYLTDPQIHSVDQKVFTTNFGKRGIFYFFNNQHVECNEICHRLSLTRPSMEKPCT

SEQ ID NO: 737894 - protein, 1226 aa, Homo sapiens
MNNQLEAPDVSEEDKSEDQRCRALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVNIRGTCLLSYSSSNDCPPELKNLHLCEAKEAFEIGLLTKRDDEPVTGKQELHSFVKAAFGLTTVHRRLHGETGTVHAASQLCKEAMGKLYNFSTSSRSQDREALSQEVMSVIAQVKEHLQVQSFSNVDDRSYVPESFECRLDKLILHGQGDFQKILDTYSQHHTSVCEVFESDCGNNKNEQKDAKTGVCITALKTEIKNIDTVSTTQEKPHCQRDTGISSSLMGKNVQRELRRGGRRNWTHSDAFRVSLDQDVETETEPSDYSNDEGAVFNKSLSGSQTSSAWSNLSGFSSSASWEEVNYHVDDRSARKEPGKEHLVDTQCSTALSEELENDREGRAMHSLRSQLHDLSLQEPNNDNLEPSQNQPQQQMPLTPFSPHNTPGIFLAPGAGLLEGAPEGIQEVRNMGPRNTSAHSRPSYRSASWSSDSGRPKNIGTHPSVQKEEAFEIIVEFPETNCDVKDRQGKEQGEEISERGAGPTFKASPSWVDPEGETAESTEDAPLDFHRVLHNSLGNISMLPCSSFTPNWPVQNPDSRKSGGPVAEQGIDPDASTVDEEGQLLDSMDVPCTNGHGSHRLCILRQPPGQRAETPNSSVSGNILFPVLSEDCTTTEEGNQPGNMLNCSQNSSSSSVWWLKSPAFSSGSSEGDSPWSYLNSSGSSWVSLPGKMRKEILEARTLQPDDFEKLLAGVRHDWLFQRLENTGVFKPSQLHRAHSALLLKYSKKSELWTAQETIVYLGDYLTVKKKGRQRNAFWVHHLHQEEILGRYVGKDYKEQKGLWHHFTDVERQMTAQHYVTEFNKRLYEQNIPTQIFYIPSTILLILEDKTIKGCISVEPYILGEFVKLSNNTKVVKTEYKATEYGLAYGHFSYEFSNHRDVVVDLQGWVTGNGKGLIYLTDPQIHSVDQKVFTTNFGKRGIFYFFNNQHVECNEICHRLSLTRPSMEKPCT

SEQ ID NO: 737895 - protein, 211 aa, Homo sapiens [sequence omitted]

SEQ ID NO: 737896 - protein, 167 aa, Homo sapiens
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGSHPAKHSM

SEQ ID NO: 737897 - protein, 110 aa, Homo sapiens
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLAYLRLHPRSGLGTVHELD

SEQ ID NO: 737898 - protein, 440 aa, Homo sapiens
KTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIKTGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEDPKWEFPRKNLVLGKTLGEGEFGKVVKATAFHLKGRAGYTTVAVKMLKENASPSELR

SEQ ID NO: 737899 - protein, 514 aa, Homo sapiens
KTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSAHARRILQQSNRNACNEAPETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEDPKWEFPRKNLVLGKTLGEGEFGKVVKATAFHLKGRAGYTTVAVKMLKENASPSELR

SEQ ID NO: 737900 - protein, 411 aa, Homo sapiens
KTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIKTGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFS

SEQ ID NO: 737901 - protein, 419 aa, Homo sapiens
KTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIKTGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFS

SEQ ID NO: 737902 - protein, 164 aa, Homo sapiens
MLSASFSAWCMCSISSCCCACSANSSISVFWFPHEYITGQRLRDDELRGLRVGKQGRRLGPGACAALAALLGPSGTVRWTWSPLEYGFSHGLLYRFDWKIHLPTAFSHSDGDTEVQRKRHLSNVTDLGGDLRPIMPRGHLSTQFFFGGAGGGDRVSLCHQAGVQ

SEQ ID NO: 737903 - protein, 71 aa, Homo sapiens
DREGARRSAALSPTQLTSTPSNTTVSFLSYNPPASDDYMKAGEGKEPGALQRPKPMGKAEKLQHSHLLVIQ

SEQ ID NO: 737904 - protein, 114 aa, Homo sapiens
LVMLIPNHLVPSTGGGSLNPFSEDVKTNPDGCAYLPSFWPFSQSPLEQSRASRAFLEDLPWRERERLDGILNKNDRLCFKLNKNKPSEEYIEVACMLPLERFIFICLSMYKGGR

SEQ ID NO: 737905 - protein, 97 aa, Homo sapiens
CQARELQRFSLGTMGSQRSTLCWDQCDRRWGQRRNCKARGTRSLNQARAGETGQGEVERKRRGWVFLPAVLPEAPCPEEAGYEGSRGTTGRGRGWTN

SEQ ID NO: 737906 - protein, 39 aa, Homo sapiens
EVWFLSAGLVTGGGLSLRGLAVAMSLHPPCQPGTGPIKT

SEQ ID NO: 737907 - protein, 122 aa, Homo sapiens
WLNVSADGDNVHLVLNVSEEQHFGLSLYWNQVQGPPKPRWHKNLTGPQIITLNHTDLVPCQTSWGPCSSLAPRVPGGSKRERSKCPGPFSQPWIATSIPRGLLRRDAGWDQGRDLGRGTGLK

SEQ ID NO: 737908 - protein, 73 aa, Homo sapiens
EKNLFQNLPCHRNPRVSLRTGLGHTDWLQNGIFSFFRSSGRRWTRKKKLEVVFGWAFISIGYQVHKNKTQAAN

SEQ ID NO: 737909 - protein, 193 aa, Homo sapiens
MDDFISQNLNTGNYSSSPGSATCRLLSVGYTHPLFSHCLLGGVDQLQSVICGQGVPSRSFRFQTPGVKDVLCAGGAGRPSHGGRRLLFPQDGTAPLWIASQMGHSEVVRVMLLRGADRDAARNDGTTALLKAANKGYNDVIKELLKFSPTLGILKNGTSALHAAVLSGNIKTVALLLEAGADPSLRNKVRWQN

SEQ ID NO: 737910 - protein, 102 aa, Homo sapiens
AVCGGCCRAGRRERAASEAAPLRNAESPGRVKGRGGQGAPGPKRAGSRSGGRGHVQDVLQEGNSTCQCCILGSQERKPGAAEAAVEQRPGGRGLQRQRTVVR

SEQ ID NO: 737911 - protein, 279 aa, Homo sapiens
MCRMSFKKETPLANAAFWAARRGNLALLKLLLNSGRVDVDCRDSHGTTLLMVAAYAGHIDCVRELVLQGADINLQRESGTTALFFAAQQGHNDVVRFLFGFGASTEFRTKDGGTALLAASQYGHMQVVETLLKHGANIHDQLYDGATALFLAAQGGYLDVIRLLLASGAKVNQPRQDGTAPLWIASQMGHSEVVRVMLLRGADRDAARNDGTTALLKAANKGYNDVIKELLKFSPTLGILKNGTSALHAAVLSGNIKTVALLLEAGADPSLRNKVRWQN

SEQ ID NO: 737912 - protein, 346 aa, Homo sapiens
MCRMSFKKETPLANAAFWAARRGNLALLKLLLNSGRVDVDCRDSHGTTLLMVAAYAGHIDCVRELVLQGADINLQRESGTTALFFAAQQGHNDVVRFLFGFGASTEFRTKDGGTALLAASQYGHMQVVETLLKHGANIHDQLYDGATALFLAAQGGYLDVIRLLLASGAKVNQPRQDGTAPLWIASQMGHSEVVRVMLLRGADRDAARNVSARVARPKSEAPGAPVWRKRVLTESAAHMGFLPTSFLEQENKVKDGTTALLKAANKGYNDVIKELLKFSPTLGILKNGTSALHAAVLSGNIKTVALLLEAGADPSLRNKANELPAELTKNERILRLLRSKEGPRKS

SEQ ID NO: 737913 - protein, 200 aa, Homo sapiens
MCRMSFKKETPLANAAFWAARRGNLALLKLLLNSGRVDVDCRDSHGTTLLMVAAYAGHIDCVRELVLQGADINLQREDGGTALLAASQYGHMQVVETLLKHGANIHDQLYDGATALFLAAQGGYLDVIRLLLASGAKVNQPRQDGTAPLWIASQMGHSEVVRVMLLRGADRDAARNVSARVARPKSEASRRACVEKTGLD

SEQ ID NO: 737914 - protein, 114 aa, Homo sapiens [sequence omitted]

SEQ ID NO: 737915 - protein, 137 aa, Homo sapiens
MGHSEVVRVMLLRGADRDAARNVSARVARPKSEAPGAPVWRKRVLTESAAHMGFLPTSFLEQENKVKDGTTALLKAANKGYNDVIKELLKFSPTLGILKNGTSALHAAVLSGNIKTVALLLEAGADPSLRNKVRWQN

SEQ ID NO: 737916 - protein, 315 aa, Homo sapiens
MGGSSPVTSKAIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRVMEVMPLMYDLKVPRWDFQTGRQLRTSPLYDRLDAQGARWMEKHGFERPKYFVPPDKDLLALEQSKTFYKPDWFDIVESEVKCCKEAVCVIDMSSFTKFEITVSIWEPKSNRLGNFTYLLNAFCFSSSKLIPDWVQWVMPVFPALWEAKGAWIT

SEQ ID NO: 737917 - protein, 134 aa, Homo sapiens
GLIFLTGYTRTGSIFLAQTQDRLISLKRINAGLNVIGIPSEIISPKKVAELHHLLNVHDLVGAMHVPEDAVVSSADVALALASAASQNGVQIYDRTSVLHVMVKKGQVTGVETDKGQIECQYFVNCAGQVGQHQ

SEQ ID NO: 737918 - protein, 336 aa, Homo sapiens
GLIFLTGYTRTGSIFLAQTQDRLISLKRINAGLNVIGIPSEIISPKKVAELHHLLNVHDLVGAMHVPEDAVVSSADVALALAVLPPKMWAYELGLSNEEPVSIPLHACEHFYLLTRPLETPLQSSTPTIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRVMEVMPLMYDLKVPRWDFQTGRQLRTSPLYDRLDAQGARWMEKHGFERPKYFVPPDKG

SEQ ID NO: 737919 - protein, 254 aa, Homo sapiens
GTYWEGGIRAVGFVHSPLLKNKGTVCKELVHITDWYPTLISLAEGQIDEDIQLDGYDIWETISEGLRSPRVDILHNIDPIYTKAKNGSWAAGYGIWNTAIQSAIRVQHWKLLTGNPGYSDWVPPQSFSNLGPNRWHNERITLSTGKSVWLFNITADPYERVDLSNRYPGIVKKLLRRLSQFNKTAVPVRYPPKDPRSNPRLNGGVWGPWYKEETKKKKPSKNQAEKKQKKSKKKKKKQQKAVSGSTCHSGVTCG

SEQ ID NO: 737920 - protein, 251 aa, Homo sapiens
GTYWEGGIRAVGFVHSPLLKNKGTVCKELVHITDWYPTLISLAEGQIDEDIQLDGYDIWETISEGLRSPRVDILHNIDPIYTKAKNGSWAAGYGIWNTAIQSAIRVQHWKLLTGNPGYSDWVPPQSFSNLGPNRWHNERITLSTGKSVWLFNITADPYERVDLSNRYPGIVKKLLRRLSQFNKTAVPVRYPPKDPRSNPRLNGGVWGPWYKEETKKKKPSKNQAEKKQKKSKKKKKKQQKAVSGKPANLAR

SEQ ID NO: 737921 - protein, 75 aa, Homo sapiens
EFNWLRPGQYMSAGPRSERESPERPLPPVFSAGLWEFAGCSECLGLRDSHLREIPGAVGGGMRVGGELQMDIVAC

SEQ ID NO: 737922 - protein, 315 aa, Homo sapiens
MSHSRGRCYIRRGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKE

SEQ ID NO: 737923 - protein, 118 aa, Homo sapiens
LGPAFTPWRSPSDPHRSLSRGLNNELCICFYSFSGISLASLLGQLNYQAASPDEGALVNAARNFGFAFLARTQNTITISELGTERTYNVLAILDFNSDRKRMSIIGKSPSESVYESLI

SEQ ID NO: 737924 - protein, 354 aa, Homo sapiens
LNFPFSGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEI

SEQ ID NO: 737925 - protein, 206 aa, Homo sapiens
MPLFFLILDIFLFPFNSWFLPKRSHVRTSLGMCLQEKCGLPSSPWMPVGSLPHPGCLWAAFLTLDACGQPSSPWMPVGCLPHPGCLWAAFLTLDACGQPSSPWMPVTWFPWGLPKLRDPKPPSNLMTRLVSEHTCVVPEPLTNPLCNPAHAFPILKGPAHRPAHVFPLPLLCPYLVGSCPFWALVWHFTHKCVLWVVSGPPPAVRG

SEQ ID NO: 737926 - protein, 206 aa, Homo sapiens; identical to SEQ ID NO: 737925

SEQ ID NO: 737927 - protein, 196 aa, Homo sapiens
MPLFFLILDIFLFPFNSWFLPKRSHVRTSLGMCLQEKCGLPSSPWMPVGAFLTLDACGQPSSPWMPVGCLPHPGCLWAAFLTLDACGQPSSPWMPVTWFPWGLPKLRDPKPPSNLMTRLVSEHTCVVPEPLTNPLCNPAHAFPILKGPAHRPAHVFPLPLLCPYLVGSCPFWALVWHFTHKCVLWVVSGPPPAVRG

SEQ ID NO: 737928 - protein, 206 aa, Homo sapiens; identical to SEQ ID NO: 737925

SEQ ID NO: 737929 - protein, 206 aa, Homo sapiens; identical to SEQ ID NO: 737925

SEQ ID NO: 737930 - protein, 68 aa, Homo sapiens
PLDFSQSHLSLGPTTTWAAPVDIFSRTPVNFRRAQFHNPLASRPTALLPPPPRGIPNDGEPQLYCEIF

SEQ ID NO: 737931 - protein, 100 aa, Homo sapiens
HSTQSKVGAIHGGRGRLETFNRAKEHKETKQQRPHQHRGPRSTNVEFDCLRDSTNDSHVSDRPPRLWREGWRRHNGWFMFWLSKSHQELWVKQADDNEEE

SEQ ID NO: 737932 - protein, 109 aa, Homo sapiens
HAPPCLANVVFLVEMGFLHVGQAGLQLPTSGDLPASVSQSAEITGMSHCTGPASIFLTDLVAFSASNSSGHISMLSFVPVLPVGIAPWKGLGLQLAELLLLRPCVRSLG

SEQ ID NO: 737933 - protein, 813 aa, Homo sapiens
LLIMVTNKMTAAFRNPSGKQVATDKVAEKLSSTLSWVKNTVSHTVSQMASQVASPSTSLHTTSSSTTLSTPALSPSSPSQLSPDVLELLAKLEEQNILLETDSKSLRSVNGSRRNSGSSLVSSSSASSNLSHLEEDSWILWGRIVNEWEDVRKKKEKQVKELVHKGIPHHFRAIVWQLLCSAQSMPIKDQYSELLKMTSPCEKLIRRDIARTYPEHNFFKEKDSLGQEVLFNVMKAYSLVDREVGYCQGSAFIVGLLLMQMPEEEAFCVFVKLMQDYRLRELFKPSMAELGLCMYQFECMIQEHLPELFVHFQSQSFHTSMYASSWFLTIFLTTFPLPVATRIFDIFMSEGLEIVFRVGLALLQMNQAELMQLDMEGMLQHFQKVIPHQFDGVPDKLIQAAYQVQYNSKKMKKLEKEYTTIKTKEMEEQVEIKRLRTENRLLKQRIETLEKHKCSSNYNEDFVLQLEKELVQARLSEAESQCALKEMQDKVLDIEKRNNSLPDENNIARLQEELIAVKLREAEAIMGLKELRQQVKDLEEHWQRHLARTTGRWKDPPKKNAMNELQDELMTIRLREAETQAEIREIKQRMMEMETQNQINSNHLRRAEQEVISLQEKVQYLSAQNKGLLTQLSEAKRKQAEIECKNKEEVMAVRLREADSIAAVAELRQHIAELEIQKEEGKLQGQLNKSDSNQYIGELKDQIAELNHELRCLKGQRGFSGQPPFDGIHIVNHLIGDDESFHSSDEDFIDNSLQETGVGFPLHGKSGSMSLDPAVADGSESETEDSVLETRESNQVVQKERPPRRRESYSTTV

SEQ ID NO: 737934 - protein, 813 aa, Homo sapiens; identical to SEQ ID NO: 737933

SEQ ID NO: 737935 - protein, 508 aa, Homo sapiens
MAPTLFQKLFSKRTGLGAPGRDARDPDCGFSWPLPEFDPSQIRLIVYQDCERRGRNVLFDSSVKRRNEDISVSKLCSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIGLSQFCSPRRAFSEQGPLRLIRSASFFAVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGM

SEQ ID NO: 737936 - protein, 222 aa, Homo sapiens
MAPTLFQKLFSKRTGLGAPGRDARDPDCGFSWPLPEFDPSQIRLIVYQDCERRGRNVLFDSSVKRRNEDISVSKLCSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIDSSTELLLYCDTSGA

SEQ ID NO: 737937 - protein, 120 aa, Homo sapiens
ESELGALTSGLRFLLPPVFPRPDGFGVLCRGLALPGFGLSSGVSLFTLLCRQRRRPGVAGTELDPLKMLEGFDVQIPGDGFERLSLIFLGNRCLSTEGYKLGGESTVGSRAVSFLFSLGS

SEQ ID NO: 737938 - protein, 110 aa, Homo sapiens
QKPFTGPADSGAELPEGHRTTESSSGSCETSLWCGNGKPAHLLTQGVTSCISLGWVASSRGSILEFSESPQRQVLHEQQALVPILIKPRASYHKLRGTDNHQCYSDTAPP

SEQ ID NO: 737939 - protein, 125 aa, Homo sapiens
GLESTGLAVCWLFSVCPPDTPTQPYPYPVWLCQGAPLPTSCSSCMAKRKLTENNGVGRERSGFYPQTPSPGPGQERLRLPAMDCWAARALLWGLPASLLSSGVGSALAPRLPNPRFLLCPFPSFP

SEQ ID NO: 737940 - protein, 103 aa, Homo sapiens
NSNGIIIEWNRMESSSGIEWNYDQMESNVIIIKWNQKEPSSIGIEWNCHQMEFKGIIIKWNRMESSLNGNERGHHQMESNGIIIKWNLMESLNRIEWNRHRMN

SEQ ID NO: 737941 - protein, 428 aa, Homo sapiens
MDSLWGPGAGSHPFGVHNTRLSPDLCPGKIVLRALKESGAGMPEQDKDPRVQENPGDQRRVPEVTGDARPAFRPLRDNGGLSPFVPGPGPLQTDLHAQRSEIRYNQTSQTSWTSSCTNRNAISSSYSSTGGLPGLKRRRGPASSHCQLTLSSSKTVSEDRPQAVSSGHTQCEKAADIAPGQTLTLRNDSSTSEASRPSTHKFPLLPRRRGEPLMLPPPLELGYRVTVEDLDREKEAAFQRINSALQVEDKAISDCRPSRPSHTLSSLATGASGLPAVSKAPSMDAQQETHKSQDCLGLLDPLASAAGVPSTAPMSGKKHRPPGPLFSSSDPLPATSSDSQDSAQVTSLIPAPFPAASMDAGMRRTRHGTSAPAAAAAAPPRSTLNPTLGSLLEWMEALHISGPQPQLQQVPRGQNQRSQTSWTSSCPK

SEQ ID NO: 737942 - protein, 108 aa, Homo sapiens
MPGPWSTLRSHRGHHCPHLHPVLRRPTLTDIEGCLQCLDVCGHTGRTRGRCPPPPCLGARSPPRTGARCRAPWTSLSCGRGECSQCPNSPAWAITQETCSLSAHPEVG

SEQ ID NO: 737943 - protein, 108 aa, Homo sapiens; identical to SEQ ID NO: 737942

SEQ ID NO: 737944 - protein, 108 aa, Homo sapiens; identical to SEQ ID NO: 737942

SEQ ID NO: 737945 - protein, 108 aa, Homo sapiens; identical to SEQ ID NO: 737942

SEQ ID NO: 737946 - protein, 113 aa, Homo sapiens [sequence omitted]

SEQ ID NO: 737947 - protein, 168 aa, Homo sapiens
MRLTEKSEGEQQLKPNNSNAPNEDQEEEIQQSEQHTPARQRTQRADTQPSRCRLPSRRTPTTSSDRTINLLEVLPWPTEWIFNPYRLPALFELYPEFLLVFKEAFHDISHCLKAQMEKIGLPIILHLFALSTLYFYKFFLPTILSLSFFILLVLLLLLFIIVFILIFF

SEQ ID NO: 737948 - protein, 124 aa, Homo sapiens
FGESPLGNPPSSLTVPCLARNRSLPSSLKAAASGAALTADHPLGPEGSRVGARPQATRGASMRGFIQNSRKEGISPHPRGQEPGCSYHRKAQASLRLKQNCKKRRLHPKNGVRLLDSTTPRARD

SEQ ID NO: 737949 - protein, 429 aa, Homo sapiens
CFTPFPIIRPITGSFAAFFKFLMPQNLHPQDVPIETRRLEAVSHFEYEVQTSASSHDSQAEVILFKKIYSSMMEKYEKIGKIGEGSYGVVFKCRNRDTGQIVAIKKFLESEDDPVIKKIALREIRMLKQLKHPNLVNLLEVFRRKRRLHLVFEYCDHTVLHELDRYQRGVPEHLVKSITWQTLQAVNFCHKHNCIHRDVKPENILITKHSVIKLCDFGFARLLTGPSDYYTDYVATRWYRSPELLVGDTQYGPPVDVWAIGCVFAELLSGVPLWPGKSDVDQLYLIRKTLGDLIPRHQQVFSTNQYFSGVKIPDPEDMEPLELKFPNISYPALGLLKGCLHMDPTERLTCEQLLHHPYFENIREIEDLAKEHNKPTRKTLRKSRKHHCFTETSKLQYLPQLTGSSILPALDNKKYYCDTKKLNYRFPNI

SEQ ID NO: 737950 - protein, 112 aa, Homo sapiens
MEPLELKFPNISYPALGLLKGCLHMDPTERLTCEQLLHHPYFENIREIEDLAKEHNKPTRKTLRKSRKHHCFTETSKLQYLPQLTGSSILPALDNKKYYCDTKKLNYRFPNI

SEQ ID NO: 737951 - protein, 174 aa, Homo sapiens
HSAREDPPEMAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 737952 - protein, 232 aa, Homo sapiens
RQSISKAVWPYYQKYVDEASKKEIKDILIQYDRTLLVADPRRCESKKFGGPGARARYQNIPGPLSAEMAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 737953 - protein, 156 aa, Homo sapiens
HSAREDPPEMAPNASCLCVHVRSEEWDLMTFDANPYDSVKLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 737954 - protein, 105 aa, Homo sapiens
RPPTTTKFAAASTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 737955 - protein, 125 aa, Homo sapiens
QVVDWGPGLWRQTAWIAGLASGCPSELHVHNADNISTSLPGLEARAQRLGTEVTTLLAGEWGQAEQLTPPLCFLRPHSNGGFTRGPWTWEPIPFPPCPSVSSLVIPATWEAEVGELLEPGRWRLQ

SEQ ID NO: 737956 - protein, 69 aa, Homo sapiens
KIRGVRGRKKSEALRQVDLPSNSDSALYSCVPLGKLLNLSDFQFYFKVEEVLIYLVRLWEKLMKHMKVP

SEQ ID NO: 737957 - protein, 423 aa, Homo sapiens
GRLRPWILMSGMEKLQNASWIYQQKLEDPFQKHLNSTEEYLAFLCGPRRSHFFLPVSVVYVPIFVVGVIGNVLVCLVILQHQAMKTPTNYYLFSLAVSDLLVLLLGMPLEVYEMWRNYPFLFGPVGCYFKTALFETVCFASILSITTVSVERYVAILHPFRAKLQSTRRRALRILGIVWGFSVLFSLPNTSIHGIKFHYFPNGSLVPGSATCTVIKPMWIYNFIIQVTSFLFYLLPMTVISVLYYLMALRLKKDKSLEADEGNANIQRPCRKSVNKMLFVLVLVFAICWAPFHIDRLFFSFVEEWSESLAAVFNLVHVVSGVFFYLSSAVNPIIYNLLSRRFQAAFQNVISSFHKQWHSQHDPQLPPAQRNIFLTECHFVELTEDIGPQFPCQSSMHNSHLPTALSSEQMSRTNYQSFHFNKT

SEQ ID NO: 737958 - protein, 147 aa, Homo sapiens
MLFVLVLVFAICWAPFHIDRLFFSFVEEWSESLAAVFNLVHVVSGVFFYLSSAVNPIIYNLLSRRFQAAFQNVISSFHKQWHSQHDPQLPPAQRNIFLTECHFVELTEDIGPQFPCQSSMHNSHLPTALSSEQMSRTNYQSFHFNKT

SEQ ID NO: 737959 - protein, 106 aa, Homo sapiens
SLEGSLWKKMYPGKHPVTYHLARIVLLLMCVLDSILFIPNTALPHPQILSSKLCFGSMTSIYNKEILKEPHGIHIYHKNVVEDVGHCTIRCLLLDSRNYLWFQPQG

SEQ ID NO: 737960 - protein, 123 aa, Homo sapiens
MALNNVSLSSGDQRSRVAYRSSHGDLRPRASALAMVSGDGFLVSRPEAIHLGPRQAVRPSVRAESRRVDGGGRSPREPDGRGRSRQARFSPYPIPAVEPDLLRSVLQQRLIALGGVIAARISV

SEQ ID NO: 737961 - protein, 123 aa, Homo sapiens; identical to SEQ ID NO: 737960

SEQ ID NO: 737962 - protein, 123 aa, Homo sapiens; identical to SEQ ID NO: 737960

SEQ ID NO: 737963 - protein, 123 aa, Homo sapiens; identical to SEQ ID NO: 737960

SEQ ID NO: 737964 - protein, 123 aa, Homo sapiens; identical to SEQ ID NO: 737960

SEQ ID NO: 737965 - protein, 40 aa, Homo sapiens
MAFIFLLYKRILKDYTKTCKRSNSSTQLRLINTVSDLIMP

SEQ ID NO: 737966 - protein, 114 aa, Homo sapiens
IRSLALLPRQCSGMISAYCHLHFLGSTDSPASASQVAGTTGCCHHIQLIFVFLVETGFLRVGQAGHELLTSNDRVALASQSAAVTGMSHMPGRQRDFTWETDQIITIYRNCNCI

SEQ ID NO: 737967 - protein, 337 aa, Homo sapiens
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADMLAKSIANCQVELLENCGHSVVMERPRKTAKLIIDFLASVHNTDNNKKLD

SEQ ID NO: 737968 - protein, 337 aa, Homo sapiens; identical to SEQ ID NO: 737967

SEQ ID NO: 737969 - protein, 337 aa, Homo sapiens; identical to SEQ ID NO: 737967

SEQ ID NO: 737970 - protein, 337 aa, Homo sapiens; identical to SEQ ID NO: 737967

SEQ ID NO: 737971 - protein, 290 aa, Homo sapiens [sequence omitted]

SEQ ID NO: 737972 - protein, 315 aa, Homo sapiens
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADMLAKSIANCQVELLENCGHSVVMERPRKTAKLIIDFLASVHNTDNNKKLD

SEQ ID NO: 737973 - protein, 178 aa, Homo sapiens
VSFTLLMMCCCHGNACLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADMLAKSIANCQVELLENCGHSVVMERPRKTAKLIIDFLASVHNTDNNKKLD

SEQ ID NO: 737974 - protein, 337 aa, Homo sapiens; identical to SEQ ID NO: 737967

SEQ ID NO: 737975 - protein, 149 aa, Homo sapiens
SYVRFKVQSCSISLISSGVDGMSEMLQLCSYVRFKVPQQILQGLVDVRIPHNNFYRKLFLEIVSEKSRYSLHQNMDKIKVPTQIIWGKQDQVLDVSGADMLAKSIANCQVELLENCGHSVVMERPRKTAKLIIDFLASVHNTDNNKKLD

SEQ ID NO: 737976 - protein, 113 aa, Homo sapiens
MCLGQTCWPSQLPTARWSFHNRLFSFCAQHRQQQEAGLRPRLQPAFCTQHLLPSPKSDAATTLRDPAPNAVGAPVTLRKPVPYPWYPRFPRALGTTRKPPRYFSQNRNSYGTK

SEQ ID NO: 737977 - protein, 139 aa, Homo sapiens
DEVSLCCPGWRVQWYGLSSLQPPPPRFKRFSSLSLLSSWDYRCLPPRPGNFFFFCIFSRDGVSPCWPGWSRTPDLMIRPCWPPKVWDYRRKPPHLAVQRISAFSSLAPSPAPISPFRMYSSCHLLWATSCDYRTTVLRS

SEQ ID NO: 737978 - protein, 139 aa, Homo sapiens; identical to SEQ ID NO: 737977

SEQ ID NO: 737979 - protein, 39 aa, Homo sapiens
MTAPVSGHTGATENLRGAFRGSTAEPQTPSQPGPGQLWR

SEQ ID NO: 737980 - protein, 47 aa, Homo sapiens
SCISAIFTSFVSDSSLISTSPKSQHHHPQFPILQIFQAVAHLPSHDP

SEQ ID NO: 737981 - protein, 129 aa, Homo sapiens
QGHTRLIFNQMDLVIANKEKENKTLSQAIVNGCYQKMALAGHQGPGQLQAAPHLLSNPRSLLGGLGQPEPGRVEDFYHEKVRALPEGAEALRVTVWEAGLLLILCRKRITLFRPGSQISAGRELSAGPV

SEQ ID NO: 737982 - protein, 130 aa, Homo sapiens
HPTTSQAKGPSPQTNKELGNFFRSLWGPYAGWAQAGLLGNAFDGHQLLRPLIFCQDHLREGPPIGRGDSQGEELEPQLPSSLSSIPYGFCDHCWTKDVDDPPLVTHPSPGSRDGHMTPSASQSSLSPGHN

SEQ ID NO: 737983 - protein, 67 aa, Homo sapiens
AAVTGQLALVQLLVERQRMLTSRTACMAGRPSCRQPTMGQCQPHALSDKARQMLWPEMEVPNGLFWS

SEQ ID NO: 737984 - protein, 107 aa, Homo sapiens
KSSPQHRTVTVADPCQTASLGGTQIYSFLLVGPPCGNFSNSSQGFTGRILISQGQSPCEEGQLWSSCFSRPSLPCMLALKIPGILDKGASPQCSMAAPLRDSQSDLL

SEQ ID NO: 737985 - protein, 130 aa, Homo sapiens
CTLTPYSATPRRGPRAPVKIRPPPQNPILLELQVVSGFYPESWRNSPHPLTHAWCPVSRRARQLPQGHKGLNPGEGTRSDLPPKRIFQFIPQHNMPGLVPASVPTPPVRMGHQGHPGVGREVNPSAAGSP

SEQ ID NO: 737986 - protein, 180 aa, Homo sapiens
MSTLGPLMSTSGTFISPSTLGTDTSISPLTLGPFKCKSTSGMEILGALKCISGILNLGPFNFPSGPSISISPTFTSILGAFTSISGPFKSPSTLGRETSTSVFSLGAFKLSPTSGIEILCVCIFMLGILNLGPFSFPSGASRFTSGTSMSTLGPETPRSALGRFISTSGPCRRGREFSSS

SEQ ID NO: 737987 - protein, 54 aa, Homo sapiens
HTELGHFHLGHFQVPIWVVNLHIWGINVHFGPFNVNISPFDFGAIMHLRHSNLG

SEQ ID NO: 737988 - protein, 194 aa, Homo sapiens
MSTLGPLMSTSGTFISPSTLGTDTSISPLTLGPFKCKSTSGMEILGALKCISGILNLGPFNFPSGPSISISPTFTSILGAFTSISGPFKSPSTLGRETSTSVFSLGAFKLSPTSGIEILCVCIFMLGILNLGPFSFPSGASRFTSGTSMSTLGPETPRSALGRFISTSGPSPLKPGMLNLGIFTLGIFRCQSGP

SEQ ID NO: 737989 - protein, 163 aa, Homo sapiens [sequence omitted]

SEQ ID NO: 737990 - protein, 208 aa, Homo sapiens
RRHRREPELPGGAASAPDWSGRAAEGSCWEFFSREGERSGERPRELGSGRACERRSQRSKPRNRSGKPGSRRKWDCERTGEQEGKEAPGLLMSEEPGKSRWKNLKTAGALLLPQERHRRPPHTPPRRLRVPPESRRQRPAGLLRGDGGLRGARSGDRGATSGIQISVWWLDVDFNEFGLHVDLVVSLIPSCGQGEGPRAALSSRRRPR

SEQ ID NO: 737991 - protein, 1894 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 737992 - protein, 1894 aa, Homo sapiens; identical to SEQ ID NO: 737991

SEQ ID NO: 737993 - protein, 1894 aa, Homo sapiens; identical to SEQ ID NO: 737991

SEQ ID NO: 737994 - protein, 1559 aa, Homo sapiens
MEFVGELVRSFCLQLVLGPLNSHVCLSEAWCPKAGSCGYGSCRDFTMPPLLLTPIPSASLQPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 737995 - protein, 1887 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEHRMSRHGGSGWLIRWSSSLMPCPLRAERRSLAFLGRGTCPSCHTGSLRWKDK

SEQ ID NO: 737996 - protein, 164 aa, Homo sapiens [sequence omitted]

SEQ ID NO: 737997 - protein, 361 aa, Homo sapiens
YSIVLYPLRLPRACWSYWTLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 737998 - protein, 144 aa, Homo sapiens
GRHQGSAMPPLCVRPHPSVNVLLQRAEAARCPLDSLLLTRLLFAQRDISQSTKLECVEMIRTAEIGTKLPQPDLRDQDMNAYLAEQSRLHAVEFNMLSALNEIYSYVSKYSEELIGALEQDEQARRQRLAYKVEQLINAMSIES

SEQ ID NO: 737999 - protein, 498 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKVRVYEFRCSNAIHLLSKESLLEGSYWWRFNYRQLYFLGEQR

SEQ ID NO: 738000 - protein, 259 aa, Homo sapiens
MERKINRREKEKEYEGKHNSLEDTDQGKNCKSTLMTLNVGGYLYITQKQTLTKYPDTFLEGIVNGKILCPFDADGHYFIDRDGLLFRHVLNFLRNGELLLPEGFRENQLLAQEAEFFQLKGLAEEVKSRWEKEQLTPRETTFLEITDNHDRSQGLRIFCNAPDFISKIKSRIVLVSKSRLDGFPEEFSISSNIIQFKYFIKSENGTRLVLKEDNTFVCTLETLKFEAIMMALKCGFRLLTSLDCSKGSIVHSDALHFIK

SEQ ID NO: 738001 - protein, 115 aa, Homo sapiens
VYILVKHSFSLLSFACSFQRYLFDIYYVLVVLLETSFLCIHYVFSAVHFCTYCSFGQNTFLRLSQKSLEGLHLPSRTSSNASVTVKTFFTTLVVAISFSYSEHYTYLCYRSYKEL

SEQ ID NO: 738002 - protein, 744 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 738003 - protein, 744 aa, Homo sapiens; identical to SEQ ID NO: 738002

SEQ ID NO: 738004 - protein, 744 aa, Homo sapiens; identical to SEQ ID NO: 738002

SEQ ID NO: 738005 - protein, 717 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCRCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 738006 - protein, 168 aa, Homo sapiens
PGRLDSKSSVFVFLPEEYCCAKWLLKAIDWVASLLLARPLHQCLHSFSPAGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 738007 - protein, 705 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNVNGLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 738008 - protein, 695 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCRCSILACSAYVALALGDNLMALNHAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 738009 - protein, 744 aa, Homo sapiens; identical to SEQ ID NO: 738002

SEQ ID NO: 738010 - protein, 744 aa, Homo sapiens; identical to SEQ ID NO: 738002

SEQ ID NO: 738011 - protein, 71 aa, Homo sapiens
TVTLKCYGKDEHGELPVILSQLLARCWVNRLPRIEELALKQLLLKNASKQTTHNCGKPGGNPSTLWHEMAV

SEQ ID NO: 738012 - protein, 417 aa, Homo sapiens
GSERPGGAGGGARSRRELPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738013 - protein, 417 aa, Homo sapiens; identical to SEQ ID NO: 738012

SEQ ID NO: 738014 - protein, 260 aa, Homo sapiens
GSERPGGAGGGARSRRELPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFPTIRGQL

SEQ ID NO: 738015 - protein, 150 aa, Homo sapiens [sequence omitted]

SEQ ID NO: 738016 - protein, 230 aa, Homo sapiens
MVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQVTAFKLPGP

SEQ ID NO: 738017 - protein, 422 aa, Homo sapiens
GLLGLPGPLMYCDICRSSAPLDVPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738018 - protein, 412 aa, Homo sapiens
TSARSRLGLNSAVPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738019 - protein, 417 aa, Homo sapiens; identical to SEQ ID NO: 738012

SEQ ID NO: 738020 - protein, 357 aa, Homo sapiens
MVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738021 - protein, 363 aa, Homo sapiens
MYEPVFELAEAVPNDMRLPGCPRRRCGAMIRNGRGAAGGAEQPGPGGRRAVRVWCDGCYDMVHYGHSNQLRQARAMGDYLIVGVHTDDDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738022 - protein, 440 aa, Homo sapiens
GLLGLPGPLMYCDICRSSAPLDVPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKPPHPIPAGDILSSEGCSQCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738023 - protein, 452 aa, Homo sapiens
MVHYGHSNQLRQARAMGDYLIVGVHTDAKEKGHLLPTTASEAPKPSGAEHLLVQKESLPLPETLAGKRATQLASTSGLRARVERQPAPTGPLVWLQLGAGKGPPTGGAGWAGVPSLPVVLFLEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738024 - protein, 311 aa, Homo sapiens
MVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738025 - protein, 391 aa, Homo sapiens
GSERPGGAGGGARSRRELPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738026 - protein, 335 aa, Homo sapiens
MIRNGRGAAGGAEQPGPGGRRAVRVWCDGCYDMVHYGHSNQLRQARAMGDYLIVGVHTDDDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738027 - protein, 475 aa, Homo sapiens
GSERPGGAGGGARSRRELPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQVSRRRNPRGPWVEVSRGKEGHLPALSGSSCPLLPIPSRFWGGHAGRAGPSALLCPSVQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738028 - protein, 336 aa, Homo sapiens
MVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738029 - protein, 375 aa, Homo sapiens
MVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKPPHPIPAGDILSSEGCSQCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738030 - protein, 159 aa, Homo sapiens
QPGGAHPVPPKSLRAELAALWPQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 738031 - protein, 382 aa, Homo sapiens
GSERPGGAGGGARSRRELPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKEPKRRGIFRQIDSGSNLTTDLIVQRIITNRLEYEARNQKKEAKEVFLEVQRQQ

SEQ ID NO: 738032 - protein, 341 aa, Homo sapiens
MYEPVFELAEAVPNDMRLPGCPRRRCGAMIRNGRGAAGGAEQPGPGGRRAVRVWCDGCYDMVHYGHSNQLRQARAMGDYLIVGVHTDDDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKEPKRRGIFRQIDSGSNLTTDLIVQRIITNRLEYEARNQKKEAKELAFLEAARQQAAQPLGERDGDF

SEQ ID NO: 738033 - protein, 150 aa, Homo sapiens [sequence omitted]

SEQ ID NO: 738034 - protein, 348 aa, Homo sapiens
GSERPGGAGGGARSRRELPGCPRRRCGAMIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQVSRRRNPRGPWVEVSRGKEGHLPALSGSSCPLLPIPSRFWGGHAGRAGPSALLCPSVQEMSSEYREYADSFGKCPGGRNPWTGVSQFLQTSQKIIQFASGKEPQPGETVIYVAGAFDLFHIGHVDFLEKVHRLAERPYIIAGLHFDQVTAFKLPGP

SEQ ID NO: 738035 - protein, 181 aa, Homo sapiens
MEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIRKFPERLYWAFSHWRTAKKAGQRDTNNERATTRKCGEGKSGNRKGNIPKFSLY

SEQ ID NO: 738036 - protein, 67 aa, Homo sapiens
GRRPGSSPGPGPGPAPASKDRAEGGAHWREEALDFLRILSLSHRGAEGVGQKNCQILESLKPCPRIW

SEQ ID NO: 738037 - protein, 88 aa, Homo sapiens
HGLGPLFSELLRCPPPFTSQLLHTLLCILQLKVRSLDQQQKLQQQLGSTSDLFILMRSQGDSDAHSSLRSAARNHLCFSSLSLYVALT

SEQ ID NO: 738038 - protein, 931 aa, Homo sapiens
PSFLPERSLPFSRKRKKRMTVSKEMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSQECGNGFSLASHFQDLQIVHTKEQPYKRYVCSNSFSHNLHLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 738039 - protein, 907 aa, Homo sapiens
MVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSQECGNGFSLASHFQDLQIVHTKEQPYKRYVCSNSFSHNLHLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 738040 - protein, 907 aa, Homo sapiens; identical to SEQ ID NO: 738039

SEQ ID NO: 738041 - protein, 161 aa, Homo sapiens
DSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQVQCSFLAALGL

SEQ ID NO: 738042 - protein, 1580 aa, Homo sapiens
DSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKELTLPEQTFMGYWTIGQARSGMQKLLCPVETHHIDIKGPALINIQEYPIERHEERSLNFTEECASWRIPLDEINIICDIATSHENEQNTLYVVTCNPASLYFMNMTGKSGFFVDFFDIFPRTANGVWHPFVTVAPLGSPLKGQVVLHEQQSNVILLLDTTGRALHRLILPSEKFTSKKPFWWNKEEAETYKMCKEFSHKNWLVFYKEKGNSLTVLDVLEGRTHTISLPINLKTVFLVAEDKWLLVESKTNQKYLLTKPAHIESEGSGVCQLYVLKEEPPSTGFGVTQETEFSIPHKISSDQLSSEHLSSAVEQKIASPNRILSDEKNYATIVVGFPDLMSPSEVYSWKRPSSLHKLKGTDTSFYRGKKKRGTPKQSNCVTLLDTNQVVRILPPGEVPLKDIYPKDVTPPQTSGYIEVTDLQSKKLRYIPIPRSESLSPYTTWLSTISDTDALLAEWDKSGVVTVDMGGHIRLWETGLERLQRSLMEWRNMIGQDDRNMQITINRDSGEDVSSPKHGKEDPDNMPHVGGNTWAGGTGGRDTAGLGGKGGPYRLDAGHTVYQVSQAEKDAVPEEVKRAAREMGQRAFQQRLKEIQMSEYDAATYERFSGAVRRQVHSLRIILDNLQAKGKERQWLRHQATGELDDAKIIDGLTGEKAIYKRRGELEPQLGSPQQKPKRLRLVVDVSGSMYRFNRMDGRLERTMEAVCMVMEAFENYEEKFQYDIVGHSGDGYNIGLVPMNKIPKDNKQRLEILKTMHAHSQFCMSGDHTLEGTEHAIKEIVKEEADEYFVIVLSDANLSRYGIHPAKFAQILTRDPQVNAFAIFIGSLGDQATRLQRTLPAGRSFVAMDTKDIPQILQQIFTSTMLSSV

SEQ ID NO: 738043 - protein, 1263 aa, Homo sapiens
MERGRRSEGEYEGILSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKELTLPEQTFMGYWTIGQARSGMQKLLCPVETHHIDIKGPALINIQEYPIERHEERSLNFTEECASWRIPLDEINIICDIATSHENEQNTLYVVTCNPASLYFMNMTGKSGFFVDFFDIFPRTANGVWHPFVTVAPLGSPLKGQVVLHEQQSNVILLLDTTGRALHRLILPSEKFTSKKPFWWNKEEAETYKMCKEFSHKNWLVFYKEKGNSLTVLDVLEGRTHTISLPINLKTVFLVAEDKWLLVESKTNQKYLLTKPAHIESEGSGVCQLYVLKEEPPSTGFGVTQETEFSIPHKISSDQLSSEHLSSAVEQKIASPNRILSDEKNYATIVVGFPDLMSPSEVYSWKRPSSLHKLKGTDTSFYRGKKKRGTPKQSNCVTLLDTNQVVRILPPGEVPLKDIYPKDVTPPQTSGYIEVTDLQSKKLRYIPIPRSESLSPYTTWLSTISDTDALLAEWDKSGVVTVDMGGHIRLWETGLERLQRSLMEWRNMIGQDDRNMQITINRDSGEDVSSPKHGKEDPDNMPHVGGNTWAGGTGGRDTAGLGGKGGPYRLDAGHTVYQVSQAEKDAVPEEVKRAAREMGQRAFQQRLKEIQMSEYDAATYERFSGAVRRQVHSLRIILDNLQAKGKERQWLRHQATGELDDAKIIDGLTGEKAIYKRRGELEPQLGSPQQKPKRLRLVVDVSGSMYRFNRMDGRLERTMEAVCMVMEAFENYEEKFQYDIVGHSGDGYNIGLVPMNKIPKDNKQRLEILKTMHAHSQFCMSGDHTLEGTEHAIKEIVKEEADEYFVIVLSDANLSRYGIHPAKFAQILTRDPQVNAFAIFIGSLGDQATRLQRTLPAGRSFVAMDTKDIPQILQQIFTSTMLSSV

SEQ ID NO: 738044 - protein, 1562 aa, Homo sapiens
DSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVASEYFEKAIPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKELTLPEQTFMGYWTIGQARSGMQKLLCPVETHHIDIKGPALINIQEYPIERHEERSLNFTEECASWRIPLDEINIICDIATSHENEQNTLYVVTCNPASLYFMNMTGKSGFFVDFFDIFPRTANGVWHPFVTVAPLGSPLKGQVVLHEQQSNVILLLDTTGRALHRLILPSEKFTSKKPFWWNKEEAETYKMCKEFSHKNWLVFYKEKGNSLTVLDVLEGRTHTISLPINLKTVFLVAEDKWLLVESKTNQKYLLTKPAHIESEGSGVCQLYVLKEEPPSTGFGVTQETEFSIPHKISSDQLSSEHLSSAVEQKIASPNRILSDEKNYATIVVGFPDLMSPSEVYSWKRPSSLHKLKGTDTSFYRGKKKRGTPKQSNCVTLLDTNQVVRILPPGEVPLKDIYPKDVTPPQTSGYIEVTDLQSKKLRYIPIPRSESLSPYTTWLSTISDTDALLAEWDKSGVVTVDMGGHIRLWETGLERLQRSLMEWRNMIGQDDRNMQITINRDSGEDVSSPKHGKEDPDNMPHVGGNTWAGGTGGRDTAGLGGKGGPYRLDAGHTVYQVSQAEKDAVPEEVKRAAREMGQRAFQQRLKEIQMSEYDAATYERFSGAVRRQVHSLRIILDNLQAKGKERQWLRHQATGELDDAKIIDGLTGEKAIYKRRGELEPQLGSPQQKPKRLRLVVDVSGSMYRFNRMDGRLERTMEAVCMVMEAFENYEEKFQYDIVGHSGDGYNIGLVPMNKIPKDNKQRLEILKTMHAHSQFCMSGDHTLEGTEHAIKEIVKEEADEYFVIVLSDANLSRYGIHPAKFAQILTRDPQVNAFAIFIGSLGDQATRLQRTLPAGRSFVAMDTKDIPQILQQIFTSTMLSSV

SEQ ID NO: 738045 - protein, 714 aa, Homo sapiens
DSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKE

SEQ ID NO: 738046 - protein, 714 aa, Homo sapiens; identical to SEQ ID NO: 738045

SEQ ID NO: 738047 - protein, 209 aa, Homo sapiens
DPPLNKNNNYGDDHKEDNKLGDTVVLTAHSGYSSVGAPRSTGQIGKKRFPPPGIQKSEPNWFSRAPLGDPLACGSEELDGPWKPTLSQTWSQFTDQKVCRASISVEVRSSGAASCRIRHEILQKLVAAFGELRSLADQGIINYPYSTREVVNIVKHLQKFPTEGLSSVVRNVFDFDSYNNDMREILINTLHKYGIPIGAKPTSVQLAKE

SEQ ID NO: 738048 - protein, 69 aa, Homo sapiens
MEHTQASSWAMSVSSSQGLKSSRMEDLATSSGFLAFFSAYCCSRSSCSCAAFLSSSSLSLPNRSVSSSS

SEQ ID NO: 738049 - protein, 69 aa, Homo sapiens; identical to SEQ ID NO: 738048

SEQ ID NO: 738050 - protein, 69 aa, Homo sapiens; identical to SEQ ID NO: 738048

SEQ ID NO: 738051 - protein, 165 aa, Homo sapiens
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCSTLPGLLQSMDLSTLKCYPPGQPEKFSAFLDKVVGLQK

SEQ ID NO: 738052 - protein, 165 aa, Homo sapiens; identical to SEQ ID NO: 738051

SEQ ID NO: 738053 - protein, 165 aa, Homo sapiens; identical to SEQ ID NO: 738051

SEQ ID NO: 738054 - protein, 133 aa, Homo sapiens
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCSSSLRH

SEQ ID NO: 738055 - protein, 187 aa, Homo sapiens
KRREWPSLPPSLHLSPMLDTSCLQTSDSKFFSFGTRTGSPCSSACRHPIVGPCDCKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCRLILKKCLLVVEGGDKEILWVAGGSQLGLKFC

SEQ ID NO: 738056 - protein, 170 aa, Homo sapiens
MNNHQLELAKQLHKEGHLFYCTCRVLTCPGQAKSIASAPGKCQDSAALTSTAFSGLDFGLLSGYLHKQALVTATHPTCTLLFPSCHAFFPLPLTPTLYKMHKGWKNYCSQKSLNEASMDEYLGSLGLFRKLTAKDASCLFRAISEQLFCSQVHHLEIRKACVSYMRENQQ

SEQ ID NO: 738057 - protein, 165 aa, Homo sapiens; identical to SEQ ID NO: 738051

SEQ ID NO: 738058 - protein, 170 aa, Homo sapiens; identical to SEQ ID NO: 738056

SEQ ID NO: 738059 - protein, 53 aa, Homo sapiens
MHRVLLTGETPLELGMQNSYEGLLPRSGLDHLQGWTFNLLGSFPGDESMLGGS

SEQ ID NO: 738060 - protein, 67 aa, Homo sapiens
MDHWTMSSGIRMSEGQDQKNGPGRPTYTHVWTAWCPSLSHVSNGLCFQSGAVHESCGLSSPDCSSMK

SEQ ID NO: 738061 - protein, 456 aa, Homo sapiens
EGRAILFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCHTHLGHLLNPGELVLGFDLANCNLNDEHGNKMNSDRVPDVVLIKKNYDWTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 738062 - protein, 319 aa, Homo sapiens
VWRCEAYRTMEYMTESTDRSPGLILCCECGIAISPNPANICVACLQSKVGISQDIPKQVSLLFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHP

SEQ ID NO: 738063 - protein, 57 aa, Homo sapiens
MAGIMAISMKLALYPRQGRSHQSLVDTSAGKPAAKVGVGSHPEEVGRALEDSTWSPD

SEQ ID NO: 738064 - protein, 146 aa, Homo sapiens [sequence omitted]

SEQ ID NO: 738065 - protein, 81 aa, Homo sapiens
FEDNRDLALLRVNIVNLNAYCTVVDIGREDQRDRLNGCWLQDRPGNGPLGHILAHRSPCCHLPLSTERIVRKHNLVNRGFG

SEQ ID NO: 738066 - protein, 79 aa, Homo sapiens
PAAGVGIRQCSPVRGWAGKSCVSFEHMSVKSCFLSSPIAGPHHSSCLKVLVGVTGWWLVSGVSKWVTALCGSRGWPCPR

SEQ ID NO: 738067 - protein, 127 aa, Homo sapiens
LGALRGIFLSPRAWVGISRHEKGDTGVQDWGCPWASLRLPPRIGTCLPHLSSGTAPIQLGVLGNLVQGAGRAQSGPGFPRDHTAGWGALAGAHFAHPEWASCQPCPTLTPLHQACCSWRAEPIYRSL

SEQ ID NO: 738068 - protein, 103 aa, Homo sapiens
PFLSLSLSHTHTYIHAWRHRYTQLFCIVFWILFQSLSSCMFHSCEAKQSQRISELTVTTVQKISSNPQQGGEWLLIHPNEVISSSLCWSSVNKKTDNPASFAE

SEQ ID NO: 738069 - protein, 394 aa, Homo sapiens
MTAGRSQERRAQEMGRGSVQGLDLKGDLEFFTAPMLSLRSFVFVGVGSGLTSSHIPAQRWAEWGQCLAPPARSLLTSGSLCCPRTMNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 738070 - protein, 394 aa, Homo sapiens; identical to SEQ ID NO: 738069

SEQ ID NO: 738071 - protein, 444 aa, Homo sapiens
PIRLMQVLMSRRGIKDILAKPITDYLVPGRACWAGDWRGTWSSFCLLSCPMTAGRSQERRAQEMGRGSVQGLDLKGDLEFFTAPMLSLRSFVFVGVGSGLTSSHIPAQRWAEWGQCLAPPARSLLTSGSLCCPRTMNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 738072 - protein, 71 aa, Homo sapiens
SRVINFFTSVVVSAHPVRWHSIHPLNIQTVTKQWECPKARSKSTKSIWSPARGSVGLGGLPEECWFPPEIP

SEQ ID NO: 738073 - protein, 111 aa, Homo sapiens [sequence omitted]

SEQ ID NO: 738074 - protein, 72 aa, Homo sapiens
IQEIDMTAIMALATGRDRVSAVSGNQRVASLLIDAGANVNVKDRNGKTPLMSVVSLLEERKKKQRPKKSCVC

SEQ ID NO: 738075 - protein, 148 aa, Homo sapiens
VTQINMSHRSLLYIVLHHPEIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGG

SEQ ID NO: 738076 - protein, 336 aa, Homo sapiens
MEPQKIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQVGMLFLPIKANF

SEQ ID NO: 738077 - protein, 188 aa, Homo sapiens
MVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQVGMLFLPIKANF

SEQ ID NO: 738078 - protein, 304 aa, Homo sapiens
MEPQKIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMSVVSLLEERKKKQRPKKSCVC

SEQ ID NO: 738079 - protein, 330 aa, Homo sapiens
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQVGMLFLPIKANF

SEQ ID NO: 738080 - protein, 330 aa, Homo sapiens; identical to SEQ ID NO: 738079

SEQ ID NO: 738081 - protein, 345 aa, Homo sapiens
MEPQKIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 738082 - protein, 248 aa, Homo sapiens
MEPQKIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVAHLMLLKPMGRT

SEQ ID NO: 738083 - protein, 288 aa, Homo sapiens
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEVNESIFM

SEQ ID NO: 738084 - protein, 268 aa, Homo sapiens
MEPQKIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVISCCYGCGVGQRLQLQFDPCLGTSICRRYSPKKEKKRNFGRDS

SEQ ID NO: 738085 - protein, 104 aa, Homo sapiens
LRRIPNGLSAKVSQFFQSGFSGFLSWREISAFSDVRAGADNGAKLGFSELKVCLILKFLLEGKKGRLKGHQELEGKKGRLKGHQELEGKKGRLKGHQELRSCVW

SEQ ID NO: 738086 - protein, 113 aa, Homo sapiens
WGRPQLCKLLWPWVTKPTRALSFLWGGAGKASGPWGWRALRSSVPFTSAEGKESPKAQSCARLGVTRARHSGGQGVEGGAGAGVEEELDPVAVGSQLPKAKTRATVAGTEIKL

SEQ ID NO: 738087 - protein, 758 aa, Homo sapiens
MSGESGQPEAGPSHAGLDWPNPERNRAGVPGGVIRRAGSQGPRSWIQKVLEQIMDSPRQCVTPSEVVPVTVLAVQRYLLEDEPRDTVPKPPLYCYDVTISDGVYQEKCYLDPSLNSLVYQNILKVGIQMRISRVSCLYNEKRIGQGILCIDNVHCGETSDSISLETPFRNRAHQEKPERPLRGGKSHYLALWNNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKNANRPSTSQAARVEIQERNGKRHQDDEPVNSQYFQTTSTNLSLSNKIRILQGPHANPVAVPQPGASVQTKGIKPGMPSIFNRRANINANLQGKARKTISDRWESQLWREKKFGLIDHLHYSRVYPESIPRKFMFEHRKFLSDQYNSQPAKYVPPEGRPPKLDDFKSARSLGHFEVTILGLNHEIAIDVAFLPMYCPEDIRTSQIDTLLTSMNYSCAYPQDTTGNDRLPGPRAVAGDIIKAATELDRVHIVGILDICNLGNNKVEVYLHKIYSPENTS

SEQ ID NO: 738088 - protein, 567 aa, Homo sapiens
MSGESGQPEAGPSHAGLDWPNPERNRAGVPGGVIRRAGSQGPRSWIQKVLEQIMDSPRQCVTPSEVVPVTVLAVQRYLLEDEPRDTVPKPPLYCYDVTISDGVYQEKCYLDPSLNSLVYQNILKVGIQMRISRVSCLYNEKRIGQGILCIDNVHCGETSDSISLETPFRNRAHQEKPERPLRGGKSHYLALWNNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKVKNFIQWIRTKSDSGEQKNMVIGGYYPYPPVPETFSKYSSSIKGTNVIASPSKYVYILYVWLMLFQLVIFILFFYGSDLKFSNIHR

SEQ ID NO: 738089 - protein, 135 aa, Homo sapiens
ICKTSVSPRVFIYGGKHQPHFRPRFLWDTGYAQLVHHNHNAARRPTKSVDKKRSSRRPMRVRNTFFVDELVDVALLGLKMGSPYVAQAGLELLGSRNPSTSGSQSAEITGCELPHPAMKTSVNLNYRVLLKVRYT

SEQ ID NO: 738090 - protein, 135 aa, Homo sapiens; identical to SEQ ID NO: 738089

SEQ ID NO: 738091 - protein, 90 aa, Homo sapiens
TCAHNLGDLEIEPPHLPRLMPMHTLWAPEDRALFAYCHLHTISRVLEIGLLYPPLLSLTNVIQWHKDRPFLLTTGKCAHIPESQGLACSA

SEQ ID NO: 738092 - protein, 119 aa, Homo sapiens
MAALISPGSVRKLKLQFHKILGRFACTSEHPVSSLQQPFIRCRHSFSLSALLCLHVPFYPSQMSCPILVTLFKHPLKITIGRVRCLTPVTPTLWEAKASGSQGQEIETILANMVKPRLY

SEQ ID NO: 738093 - protein, 128 aa, Homo sapiens
MAALISPGSVRKLKLQFHKILGRFACTSEHPVSSLQQPFIRCRHSFSLSALLCLHVPFYPSQMRCLQFMTQVITVTTTIFLGTTYDAISPELYTTYFVYQDPSCNLPVIMNSNSRPRDSDTLVWIGGY

SEQ ID NO: 738094 - protein, 850 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 738095 - protein, 858 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKHLGFELKEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 738096 - protein, 852 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPVGYTGDRCQQFAMVNFSKHLGFELKEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 738097 - protein, 844 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPVGYTGDRCQQFAMVNFSKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 738098 - protein, 277 aa, Homo sapiens
PPPRRPLALAHASASPRRYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 738099 - protein, 263 aa, Homo sapiens
GRGKKHPEGRKREREPDPGEKATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKAPGLHCLELGTQSHHFPISASPGSSQGSWNQLPQHPLSALGGEGSPGGDAVRTPGPQSCAGEGQGGGGQGRAQRPFCGWTSWEGRWAGLLGFLMTPEWNKKERT

SEQ ID NO: 738100 - protein, 870 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQSVLWDDTGDRCQQFAMVNFSKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 738101 - protein, 878 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQSVLWDTPGTGVSSSQWSTSPSTFGFELKEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 738102 - protein, 638 aa, Homo sapiens
GRGKKHPEGRKREREPDPGEKATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 738103 - protein, 510 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKTPLYKDAIPGCCLCPFSPQPPLHGMRGYQQGHYSRAPGLHCLELGTQSHHFPISASPGSSQGSWNQLPQHPLSALGGEGSPGGDAVRTPGPQSCAGEGQGGGGQGRAQRPFCGWTSWEGRWAGLLGFLMTPEWNKKERT

SEQ ID NO: 738104 - protein, 120 aa, Homo sapiens
MPLHSRLGDRDSKNKKRKREKEIESKQAASEWEAVDVANLSLKSGLCTHLLTHSFIHCLFIKYLFGTNTSVGLGAKVNVFQIGILKELETQEIRVNFRNHRYLTFHPASHSFVNARSQCL

SEQ ID NO: 738105 - protein, 114 aa, Homo sapiens
GAGVCRTLHPGQDAQHARPQEPLHTPLVSPHYRQGQPLSWRHRTFNRPALPVLEIYRNRLGQVRWLTPVMPALWEAKADGLLEVRSSRPAWPTWQNPVSSKNTKKISQCGSVHL

SEQ ID NO: 738106 - protein, 173 aa, Homo sapiens
KCAQSTSACLGVRICGMQVYQTDKKYFLCKDKYYGRKLSVEGFRQALYQFLHNGSHLRRELLEPILHQLRALLSVIRSQSSYRFYSSSLLVIYDGQEPPERAPGSPHPHEAPQAAHGSSPGGLTKVDIRMIDFAHTTYKGYWNEHTTYDGPDPGYIFGLENLIRILQDIQEGE

SEQ ID NO: 738107 - protein, 377 aa, Homo sapiens
IKGTGAGQFPTPQRSLSLPSSLALPPPTHWLPPPALSSFCAPGATRQSSRIMEFLSEKFALKSPPSKNSDFYMGAGGPLEHVMETLDNESFYSKASAGKCVQAFGPLPRAEHHVRLERTSPCQDSSVNYGITKVEGQPLHTELNRAMDNCNSLRMSPVKGMQEKGELDELGDKCDSNVSSSKKRRHRTTFTSLQLEELEKVFQKTHYPDVYVREQLALRTELTEARVQVWFQNRRAKWRKRERYGQIQQAKSHFAATYDISVLPRTDSYPQIQNNLWAGNASGGSVVTSCMLPRDTSSCMTPYSHSPRTDSSYTGFSNHQNQFSHVPLNNFFTDSLLTGATNGHAFETKPEFERRSSSIAVLRMKAKEHTANISWAM

SEQ ID NO: 738108 - protein, 377 aa, Homo sapiens; identical to SEQ ID NO: 738107

SEQ ID NO: 738109 - protein, 123 aa, Homo sapiens
EQGSWSEGGRQKGERTRWVTAPRGTWDRHWPLAFQHGGFRQALSSLLLNLLPERGILIPPSPAQPNHDASGSLVPPLTEARSRVGLGIPSGDGVCGLRLGKSGPLNALLKMTGPCLLVGTASW

SEQ ID NO: 738110 - protein, 128 aa, Homo sapiens
KPRGQVSSLRGSLGQSFCSGALHESSPGKLSLKSETAQAQHRGQSLATGSGPSLDFLPSSIFASLGLSSSMPALRCSPTPPCTWDHRPLVFSFSCESPPGYCCFLEGCPGLRPALLSLPRKDNQKDKP

SEQ ID NO: 738111 - protein, 124 aa, Homo sapiens
ITSTPAAGSHPWGPSGLWKASPDQRALCSRSSHRASSMGHPSREPVSLCAQSCISNGRFSLTLSLLHLGILPCGATCILLEPLPYPKPFFHNEGLRLCNPSRLPGSSVFAEDVVDITDTPGSAR

SEQ ID NO: 738112 - protein, 112 aa, Homo sapiens
ARQRARTPDHRLGWSWEGPGDTWGVYTMEQSLLQCSLGASVRPQPPGRAQCCIPRCCRLRPSQLRVLTCRPQLSLPTPCLPLLTGTSQAEASGSRRSLSPLPPGLLRVYHQE

SEQ ID NO: 738113 - protein, 281 aa, Homo sapiens
LSNCVRLSDASVMKLSERCPNLNYLSLRNCEHLTAQGIGYIVNIFSLVSIDLSGTDISNEGLNVLSRHKKLKELSVSECYRITDDGIQAFCKSSLILEHLDVSYCSQLSDMIIKALAIYCINLTSLSIAGCPKITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQSSVTFSLKQEEQKIKNLASFLHLLQVCLLAESQ

SEQ ID NO: 738114 - protein, 949 aa, Homo sapiens
KREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKESRRDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPVKKERSPRPQSFCHSSSISPQDKLALPGFSTPRDKQRLSYGAFTNQIFVSTSTDSPTSPTTEAPPLPPRNAGKGPTGPPSTLPLSTQTSSGSSTLSKKRPPPPPPGHKRTLSDPPSPLPHGPPNKGAVPWGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHILSD

SEQ ID NO: 738115 - protein, 949 aa, Homo sapiens; identical to SEQ ID NO: 738114

SEQ ID NO: 738116 - protein, 892 aa, Homo sapiens
KREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKESRRDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPVKKERSPRPQSFCHSSSISPQDKLALPGFSTPRDKQRLSYGAFTNQIFVSTSTDSPTSPTTEAPPLPPRNAGKGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHILSD

SEQ ID NO: 738117 - protein, 949 aa, Homo sapiens; identical to SEQ ID NO: 738114

SEQ ID NO: 738118 - protein, 949 aa, Homo sapiens; identical to SEQ ID NO: 738114

SEQ ID NO: 738119 - protein, 949 aa, Homo sapiens; identical to SEQ ID NO: 738114

SEQ ID NO: 738120 - protein, 949 aa, Homo sapiens; identical to SEQ ID NO: 738114

SEQ ID NO: 738121 - protein, 644 aa, Homo sapiens
KREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKESRRDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPVKKERSPRPQSFCHSSSISPQDKLALPGFSTPRDKQRLSYGAFTNQIFVSTSTDSPTSPTTEAPPLPPRNAGKGPTGPPSTLPLSTQEPGIITSEFA

SEQ ID NO: 738122 - protein, 705 aa, Homo sapiens
KREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKESRRDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPVKKERSPRPQSFCHSSSISPQDKLALPGFSTPRDKQRLSYGAFTNQIFVSTSTDSPTSPTTEAPPLPPRNAGKGNDGGPSSSSKTTNKFEGLSQQSSTSSAKTALGPRVLPKLPQKVALRKTDHLSLDKATIPPEIFQKSSQLAELPQKPPPWRSRLQ

SEQ ID NO: 738123 - protein, 171 aa, Homo sapiens
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYREDPASTTLVSIPPELRL

SEQ ID NO: 738124 - protein, 176 aa, Homo sapiens
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 738125 - protein, 194 aa, Homo sapiens
VVERDGGGDPLSSWLDRSMALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 738126 - protein, 189 aa, Homo sapiens
VVERDGGGDPLSSWLDRSMALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYREDPASTTLVSIPPELRL

SEQ ID NO: 738127 - protein, 176 aa, Homo sapiens; identical to SEQ ID NO: 738124

SEQ ID NO: 738128 - protein, 187 aa, Homo sapiens
PTLSTHAYARSMALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 738129 - protein, 170 aa, Homo sapiens
MAAHPRRCPDNTCVPCIGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 738130 - protein, 160 aa, Homo sapiens
MKLKSHKRSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 738131 - protein, 123 aa, Homo sapiens
MVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 738132 - protein, 90 aa, Homo sapiens
PTLSTHAYARSMALWRAYQRALAAHPWKVQVLTADFWGGRQHCWPHASSYTCRPRPPGLKDTLPAPHSKKPLLAPLPSAHETQKPQKALW

SEQ ID NO: 738133 - protein, 152 aa, Homo sapiens
MAAHPRRCPDNTCVPCIGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRVSWAGVENVSGWRADSPGEEDRFYRDKKGGKCR

SEQ ID NO: 738134 - protein, 138 aa, Homo sapiens
MAAHPRRCPDNTCVPCIGSLMGLGDIISQQLVERRGLQEHQRGRTLTMVSLGCGFVGPVVGGWYKVLDRFIPGTTKVDALKKMLLDQDYPDALITNYYLWPAVQLANFYLVPLHYRLAVVQCVAVIWNSYLSWKAHRL

SEQ ID NO: 738135 - protein, 158 aa, Homo sapiens
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRVSWAGVENVSGWRADSPGEEDRFYRDKKGGKCR

SEQ ID NO: 738136 - protein, 152 aa, Homo sapiens; identical to SEQ ID NO: 738133

SEQ ID NO: 738137 - protein, 113 aa, Homo sapiens
MALWRAYQRALAAHPWKVQVLTAGSLMGLGDIISQQLVERRGLQEHQRGRTLTMVSLGCGFVDYPDALITNYYLWPAVQLANFYLVPLHYRLAVVQCVAVIWNSYLSWKAHRL

SEQ ID NO: 738138 - protein, 142 aa, Homo sapiens
MKLKSHKRSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRVSWAGVENVSGWRADSPGEEDRFYRDKKGGKCR

SEQ ID NO: 738139 - protein, 158 aa, Homo sapiens; identical to SEQ ID NO: 738135

SEQ ID NO: 738140 - protein, 177 aa, Homo sapiens
LRIPLIATRRCPDNTCVPCIGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYVRADTSTACSPASLSLELSWDWAVNPDMGNPSVGITLSFPGWAP

SEQ ID NO: 738141 - protein, 121 aa, Homo sapiens
PTLSTHAYARSMALWRAYQRALAAHPWKVQVLTADFWGGRQHCWPHASSYTCRPRPPGLKDTLPAPHSKKPLLAPLPSAHETQKPQKNIAVCHPHEVTRSRMMEFGGVKTERKCISLGNVL

SEQ ID NO: 738142 - protein, 87 aa, Homo sapiens
PTLSTHAYARSMALWRAYQRALAAHPWKVQVLTADFWGGRQHCWPHASSYTCRPRPPGLKDTLPAPHSKKPLLAPLPSAHETQKPQK

SEQ ID NO: 738143 - protein, 85 aa, Homo sapiens
FEEERHVPYLYETNLENDGFISNGNKDLSIIIKIRLLSVNLIHVLSGSMRWGLQSVAKKQSRVACEHQSAQYTRIEVQQVSNEAD

SEQ ID NO: 738144 - protein, 91 aa, Homo sapiens
QEAMGRGAGQKAQSRLRGLQGAVWGLLPLAGRATSQQAQWKQRLKGRKQNHPRALRPSWVFKLQATESACGALHRPAKRSPSTRPGSSSRS

SEQ ID NO: 738145 - protein, 77 aa, Homo sapiens
SVFLLMQSARSRVSAARGPVCNPARHVYSPPPRALPQVLLQPGPRSAAADPVHTARGYDPWDLPSAQLELPSWPTEQ

SEQ ID NO: 738146 - protein, 103 aa, Homo sapiens
MKDCSNGCSAECTGEGGSKEVVGTFKAKDLIVTPATILKEKPDPNNLVFGTVFTDHMLTVEWSSEFGWEKPHIKPLQNLSLHPGSSALHYAVEELRLISFCPM

SEQ ID NO: 738147 - protein, 386 aa, Homo sapiens
MKDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 738148 - protein, 386 aa, Homo sapiens; identical to SEQ ID NO: 738147

SEQ ID NO: 738149 - protein, 323 aa, Homo sapiens
MKDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWVGAFDMNNFCKPEIKNNQNKPS

SEQ ID NO: 738150 - protein, 547 aa, Homo sapiens
VRGGGVGEVQKDEKPVEAELSRSEPGWRQRNRRESLTAERPSTAERQQPPWPPASDKKLQLMQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYKSITRARFEELCSDLFRSTLEPVEKALRDAKLDKAQIHDFVLGGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDEVD

SEQ ID NO: 738151 - protein, 703 aa, Homo sapiens
VRGGGVGEVQKDEKPVEAELSRSEPGWRQRNRRESLTAERPSTAERQQPPWPPASDKKLQLMQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYKSITRARFEELCSDLFRSTLEPVEKALRDAKLDKAQIHDFVLGGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKIITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCSAQARQGDPSTGPIIEEVD

SEQ ID NO: 738152 - protein, 703 aa, Homo sapiens; identical to SEQ ID NO: 738151

SEQ ID NO: 738153 - protein, 703 aa, Homo sapiens; identical to SEQ ID NO: 738151

SEQ ID NO: 738154 - protein, 169 aa, Homo sapiens
LSPLVLEVDPNIQAVRTQEKEQIKTLNNKFASNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCSAQARQGDPSTGPIIEEVD

SEQ ID NO: 738155 - protein, 101 aa, Homo sapiens
LVLISKLPYIHFFHTVLKQIAPEYFEKNEPYLEAACNDVDRWPAPVPGKTLHLPIMGVVMKVRIPTCHDKPGTTQIVQLTQQVDTNISVILPTVHEVDIFR

SEQ ID NO: 738156 - protein, 87 aa, Homo sapiens
MGDTITAVSEKRNLPPTQVSAPSWAAAQDPPPHSEQGNPKALRNPEAPTTNRGQIREAGRGPSEAKGTDPERQTHRWELSCGKEGGR

SEQ ID NO: 738157 - protein, 115 aa, Homo sapiens [sequence omitted]

SEQ ID NO: 738158 - protein, 154 aa, Homo sapiens
SALLSQGFEPLRFSGQTRKNENTAWGAPTSRRLCQLTSGHGAAAGAHGGQGQLHILPSPSHFTVAPNPARRERVSAPQTTGSLLTKNGETRFHLSAEEPQAGLSERDGAGGRLWIASQIKLCSLNVALSPRKSLGPEFLRFMVHLIDQIYLDFF

SEQ ID NO: 738159 - protein, 119 aa, Homo sapiens
KRASTMSFNTLDRLFLGIKAPHLWAGTQFPSSSSTSRPWLPAPLSPGPSKETSSLSGPSTVSQFCGFSPFRVSASGYLPTHAHPPPHPGITAVCALGTMTPHAFSLLNRSDRSPREGRA

SEQ ID NO: 738160 - protein, 167 aa, Homo sapiens
VQDIGAGNRTEASQKHVFLVKESTRERFTAVLCYLLCTPPPYAHGRAHFSPHQTLGNTPKALAVSRLQFLRPGTLCCHLVADLRHSKLAAGILFELGLRRELWFGSNPYRALLPVMLIFKKCFTPYAPLLVFHVGTSFNVPPEATFWVLMCLVNVKESVNYLPERRQ

SEQ ID NO: 738161 - protein, 61 aa, Homo sapiens
VKHSPSISCAAQVWELPLFVACLQQGCPSHDQPEPKLPATTSISSSHQTHYFKGRKNAGHQ

SEQ ID NO: 738162 - protein, 588 aa, Homo sapiens
MYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 738163 - protein, 504 aa, Homo sapiens
MRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 738164 - protein, 423 aa, Homo sapiens
MPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 738165 - protein, 117 aa, Homo sapiens
PLRVMGETPQGPRTRFRFWLVHMLTQGAACWCEFNKYAFSSPALEGMGTWRLTPHCPVSSSPERHHHCGRPPWGQGLPAGGGEEEVICKKGSQPALKSPRTPVSHPCPHPACSSQLL

SEQ ID NO: 738166 - protein, 123 aa, Homo sapiens
MLLEWIHLNKVQSYFIPGFACVKHSPSISCAAQVWELPLFVACLQQGCPSHDQPEPKLPATTSISSSHQTHYFKGRKNAGHQVVAGILELAGCHSVQSNTYLLSNCFVSRTMRSTEVPPRLCM

SEQ ID NO: 738167 - protein, 145 aa, Homo sapiens
MSALACACAARGGVTSGGASQLEEAVAAGRGERLRGSGGGALGSDAPAMTSSPVSRVVYNGKRTSSPRSPPSSSEIFTPAHEENVRFIYEAWQGVERDLRGQVPGGERGLVEEYVEKVPNPSLKTFKPIDLSDLKRRSTQDAKKS

SEQ ID NO: 738168 - protein, 145 aa, Homo sapiens; identical to SEQ ID NO: 738167

SEQ ID NO: 738169 - protein, 145 aa, Homo sapiens; identical to SEQ ID NO: 738167

SEQ ID NO: 738170 - protein, 159 aa, Homo sapiens
RVLLCCLGWSAVPRSWLPAALTSWAQAVLPPQPLSSWDYKCMLPHQRLRGSGGGALGSDAPAMTSSPVSRVVYNGKRTSSPRSPPSSSEIFTPAHEENVRFIYEAWQGVERDLRGQVPGGERGLVEEYVEKVPNPSLKTFKPIDLSDLKRRSTQDAKKS

SEQ ID NO: 738171 - protein, 126 aa, Homo sapiens
MIILAPELQLAGERLRGSGGGALGSDAPAMTSSPVSRVVYNGKRTSSPRSPPSSSEIFTPAHEENVRFIYEAWQGVERDLRGQVPGGERGLVEEYVEKVPNPSLKTFKPIDLSDLKRRSTQDAKKS

SEQ ID NO: 738172 - protein, 145 aa, Homo sapiens; identical to SEQ ID NO: 738167

SEQ ID NO: 738173 - protein, 145 aa, Homo sapiens; identical to SEQ ID NO: 738167

SEQ ID NO: 738174 - protein, 145 aa, Homo sapiens; identical to SEQ ID NO: 738167

SEQ ID NO: 738175 - protein, 102 aa, Homo sapiens
RGLAEEDALPPRRREAWGRVIGVPLTTVLVILRGRDRPARGAGTGSAAWQGVERDLRGQVPGGERGLVEEYVEKVPNPSLKTFKPIDLSDLKRRSTQDAKKS

SEQ ID NO: 738176 - protein, 145 aa, Homo sapiens; identical to SEQ ID NO: 738167

SEQ ID NO: 738177 - protein, 126 aa, Homo sapiens; identical to SEQ ID NO: 738171

SEQ ID NO: 738178 - protein, 145 aa, Homo sapiens; identical to SEQ ID NO: 738167

SEQ ID NO: 738179 - protein, 175 aa, Homo sapiens
MRRARLRLCSPRWRHFRRGLPAGRGGGGGSGRGEAGAAGRRGRGGAGRARLAPPWCRRAAAGSPAGPGGAGRGGVAGQPGSEGGARVPRPAPAGGRGRGRLGARVGRARLGLSAFPAQAGAGAGDPAPPDARSGPAFCRRRGFGADRAPLSRSPGGTVPEDASDSRSAAGPAVRI

SEQ ID NO: 738180 - protein, 114 aa, Homo sapiens
SLNQLQDGTSSLGLGYCRAPQGGPQQPGLASWCLRSQWPLGRGTQADPEVLLLGLSWLWGVLGGSPGPFSFLCPLKAKCLCGCGARGSVNKGGGTGRGLLVVCQASAPAAHMHS

SEQ ID NO: 738181 - protein, 130 aa, Homo sapiens
MSALACACAARGGVTSGGASQLEEAVAAGRGERLRGSGGGALGSDAPAMTSSPVSRVVYNGKRTSSPRSPPSSSEIFTPAHEENVRFIYEAWQGVERDLRGQVPGGERGLVEEYVEKVPNPSLKTAWPLP

SEQ ID NO: 738182 - protein, 101 aa, Homo sapiens
RHEPSCCRLLPHLLCPPPLLTRVLCILLRSPPNPADPQRKMRGHIRWQKTRFIGGKRRIVQNGDCIVAVGRPHSLSLPASRQPPLFPPQNLYQCSVSTGQD

SEQ ID NO: 738183 - protein, 118 aa, Homo sapiens
FQAGLLNATNCTNVAECDTQHISMLQAQWGFKQALAVKTPALINLIISSYVFCLFFCLFVFETESRSVIQAGVQWCHLGSLHAPPPRFMPFSCLSLLSSWDYRHPPPRPANFLSSYVL

SEQ ID NO: 738184 - protein, 283 aa, Homo sapiens
RGAPGDCWATVPNSGLGPGVPAFSESLVPAPAGAGTRPTPRPSPAHAPAAGAGREAGARRSSPRDPFKAWRARAGMPSPVAETAVRSAPRERPSSRAPRTSPSRAERTSPEASPTTDTVQPPGGARHAEAKIDCIRRTTLDLEEDRPTEANAQHTCKACPSELDEPQELRELPPQEKWDQRTINGSAQGMLKRWKHQREAPSLKTKTTCPREVTTPGPGWALFITRARRTERMHGATKRWRKHAGEVARRLTGFNHSTELTTKTEHNHTTGDTKYSNSHTHKG

SEQ ID NO: 738185 - protein, 114 aa, Homo sapiens
PQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISP

SEQ ID NO: 738186 - protein, 74 aa, Homo sapiens
KWARPSHTQSGSAAAKKIDNRTHDPGRDAERGSPKTGRPARNRFVAHRAHSAKTHTHTGKHTQNTERGKETHRH

SEQ ID NO: 738187 - protein, 86 aa, Homo sapiens
LTPSRNSRQGCLVYSARPAQSLAGGSAQANDCRNLSERRQELATLAPAGANSMWAPHQRPGVGTSHAKPQRACNHTLSSTVRRQQC

SEQ ID NO: 738188 - protein, 80 aa, Homo sapiens
MKSEPDKADPFSFAGPEIMDCDGCTIDWKKGKNVTVKTIKKKQKRKGPGTVRTITKQVSNESFFNFFNPLKASGDGESLD

SEQ ID NO: 738189 - protein, 143 aa, Homo sapiens
MDELRWYHITVCLDHIFGHNCSLSCKDCMNGGKCQEGKSECSCPAGCRVILCNENCLEGAYGAGCTSECQCVEENTLECSAKNGSCTCKSGYQGNRCQKDGLWGPEGWFSSAPCENGGQCNKKTGNCDCTPDYTRKSCTICKS

SEQ ID NO: 738190 - protein, 268 aa, Homo sapiens
DVVGEEGYRIGNDRKTYPSLDDDELEEEEEEGEVVRFPGLLFKSPPQQLHYVATFLPPTYKDEEDEEEEEKDIHRELTALHNFVCLDHIFGHNCSLSCKDCMNGGKCQEGKSECSCPAGCRVILCNENCLEGAYGAGCTSECQCVEENTLECSAKNGSCTCKSGYQGNRCQKDGLWGPEGWFSSAPCENGGQCNKKTGNCDCTPDYTRKSCTILRCISLTNLALSRRSSPMKYQQNVSSHREVRQRQQCSSDRPFKKLLCKFSFKIGM

SEQ ID NO: 738191 - protein, 105 aa, Homo sapiens [sequence omitted]

SEQ ID NO: 738192 - protein, 169 aa, Homo sapiens
GPFKFCSSEIHTEVWTQFRRATQKETTMSLLPVPYTEAASLSTGSTVTIKGRPLACFLNEPYLQVDFHTEMKEESDIVFHFQVCFGRRVVMNSREYGAWKQQVESKNMPFQDGQEFELSISVLPDKYQVMVNGQSSYTFDHRIKPEAVKMVQVWRDISLTKFNVSYLKR

SEQ ID NO: 738193 - protein, 156 aa, Homo sapiens
ANSLVIRDCEKETTMSLLPVPYTEAASLSTGSTVTIKGRPLACFLNEPYLQVDFHTEMKEESDIVFHFQVCFGRRVVMNSREYGAWKQQVESKNMPFQDGQEFELSISVLPDKYQVMVNGQSSYTFDHRIKPEAVKMVQVWRDISLTKFNVSYLKR

SEQ ID NO: 738194 - protein, 381 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQQFPFCLMSVNITHIAIQALREECLSRECNRQQKVIPVVNSFYAATFLHLAHVWRTQRKTISDSGFVLKELEVLAKKSPRRLLKTLELYLARVSKGQASLLGAQKCYGPEAPPFKDLTFTGESDLQSHSSEGVWLI

SEQ ID NO: 738195 - protein, 391 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQQFPFCLMSVNITHIAIQALREECLSRECNRQQKVIPVVNSFYAATFLHLAHVWRTQRKTISDSGFVLKGVLFLLGRPRLNAQCPRSREPKVVARLVLAAVLPHPHFLKFQLTKISITHPLESASSPFSALTVALFWSYTYDKHIF

SEQ ID NO: 738196 - protein, 391 aa, Homo sapiens; identical to SEQ ID NO: 738195

SEQ ID NO: 738197 - protein, 391 aa, Homo sapiens; identical to SEQ ID NO: 738195

SEQ ID NO: 738198 - protein, 254 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQIERNQGKG

SEQ ID NO: 738199 - protein, 391 aa, Homo sapiens; identical to SEQ ID NO: 738195

SEQ ID NO: 738200 - protein, 161 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQ

SEQ ID NO: 738201 - protein, 139 aa, Homo sapiens [sequence omitted]

SEQ ID NO: 738202 - protein, 391 aa, Homo sapiens; identical to SEQ ID NO: 738195

SEQ ID NO: 738203 - protein, 78 aa, Homo sapiens
SDTTNMTNSVHHLLEKPTALWWGNRYTAKWPCDNPMRISVKVPGIKISITHPLESASSPFSALTVALFWSYTYDKHIF

SEQ ID NO: 738204 - protein, 146 aa, Homo sapiens
MASAGVAAGRQAEDVLPPTSDQPLPDTKPLPPPQPPPVPAPQPQQSPAPRPQSPARAREEENYSFLPLVHNIIKCMDKDSPEVHQDLNALKSKFQEMRKLISTMPGIHLSPEQQQQQLQSLREQVRTKNELLQKYKSLCMFEIPKE

SEQ ID NO: 738205 - protein, 166 aa, Homo sapiens
DAGECATLLATRPLANLPPEPWPLLGWQPGDRRRMYCRQRPTSRCLTPSRCRLLSRRRSLRLNRSSRRRHGLSHLPARGRKRTTPFYLWFTTSSNGKNLGEDQAPYSLQLLLSAVSELQEALALWGTPPFHRWGNSDPEREEAFPKTTETFHELSKRFEPREVRYP

SEQ ID NO: 738206 - protein, 110 aa, Homo sapiens
SPGKKVLLKEGEAQRLAAPNPRQVWQLISKVLGTWECVKEEIKFQWLWTEKKALDLSGWSPVRPGLPWDCYLTESVISLKFHSSGWACFKALTDTTKHEARGTTRPPGSF

SEQ ID NO: 738207 - protein, 146 aa, Homo sapiens; identical to SEQ ID NO: 738204

SEQ ID NO: 738208 - protein, 146 aa, Homo sapiens; identical to SEQ ID NO: 738204

SEQ ID NO: 738209 - protein, 124 aa, Homo sapiens
SCNSWRWPLLRPFLHSLSDFQKRHQTHAPAHSRQRLLSPCKAGPCWRLHPHGVTALGAHRDPHWHVHGAPAAKAASCQHSFVSLHTTAWKGPPSLHPPMSPLVKLKHRISRFEENLYPILKQSH

SEQ ID NO: 738210 - protein, 118 aa, Homo sapiens
NTFEGHHVPGTADTESNSSVASQHTQVKAELLERTPNPGKIWLCSFSGLLGSSHPDSCQSLGSTVPLPPQPTHALRRSFCFSSSPCLVCAACPPGLAAICFILLCLSVQSCHIAQCLS

SEQ ID NO: 738211 - protein, 113 aa, Homo sapiens
RRNLTLSPRLECNGAILAHCNLHLPPRFKQFSCFSLPSSWDYRRLPPCLANLFVFLVETGFHHVGQAVLELLTSNDPPASASQSTGIRGVSHCAWPLFFKVNILDKNWDKNMV

SEQ ID NO: 738212 - protein, 197 aa, Homo sapiens
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEGIPPLHFEGLPEFKFWHAATKGILVAMVCTFFDAFNVPVFWPILVMYFIMLFCITMKRQIKHMIKYRYIPFTHGKRRYRGKEDAGKAFAS

SEQ ID NO: 738213 - protein, 197 aa, Homo sapiens; identical to SEQ ID NO: 738212

SEQ ID NO: 738214 - protein, 197 aa, Homo sapiens; identical to SEQ ID NO: 738212

SEQ ID NO: 738215 - protein, 238 aa, Homo sapiens
MDKILNVEETYLTVLVKIGPGFHTRECFLLKSILCFSPSYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEGIPPLHFEGLPEFKFWHAATKGILVAMVCTFFDAFNVPVFWPILVMYFIMLFCITMKRQIKHMIKYRYIPFTHGKRRYRGKEDAGKAFAS

SEQ ID NO: 738216 - protein, 232 aa, Homo sapiens
MDFQVAGPSPEPDKGPLKELHSSRRKLRSKPESYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEGIPPLHFEGLPEFKFWHAATKGILVAMVCTFFDAFNVPVFWPILVMYFIMLFCITMKRQIKHMIKYRYIPFTHGKRRYRGKEDAGKAFAS

SEQ ID NO: 738217 - protein, 122 aa, Homo sapiens
MRYAKKHNIKGLKKMQANNAKAMSARAEAIKALVKPKEVKPKIPKGVSRKLDRLAYIAHPKLGKRARARIAKGLLCRPKAAAKGQDHTKAQAVSSFKFSFRLPNVPSPLQRLRDISATLRQK

SEQ ID NO: 738218 - protein, 110 aa, Homo sapiens
APPLSDQSSCPNSSLTCPPALSRLPDPSSCPNSSLTNPPALTPTCPAANSIAAWLGPGSVCCPLPSAQPRFYLGFWWLHLIKVVCNFGTKVVPCPACSWPSTLNPSVTHG

SEQ ID NO: 738219 - protein, 791 aa, Homo sapiens
GAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 738220 - protein, 822 aa, Homo sapiens
GAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKDEDVGEGWWQNTGGHLGPMGHTPDFSSLLDKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 738221 - protein, 635 aa, Homo sapiens
GAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQVREGRNRLN

SEQ ID NO: 738222 - protein, 640 aa, Homo sapiens
GAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQAPGGGWDCRSRGDL

SEQ ID NO: 738223 - protein, 603 aa, Homo sapiens
SSGLGWVVRPVGWFALQPTPQVSFLVKTENFLPLGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 738224 - protein, 376 aa, Homo sapiens
LLGVKCLWMEGLWMTKMSLDAKCLWMQSVLVDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 738225 - protein, 552 aa, Homo sapiens
GAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSR

SEQ ID NO: 738226 - protein, 389 aa, Homo sapiens [sequence omitted]

SEQ ID NO: 738227 - protein, 190 aa, Homo sapiens
MKASQCCCCLSHLLASVLLLLLLPELSGPLAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRR

SEQ ID NO: 738228 - protein, 69 aa, Homo sapiens
DSKQHPAGPMEMSLPTFTLSLPPYASLPLDKPRLMTQGTSSLPVASPSLTILKEPANKMLSSGFFQWHC

SEQ ID NO: 738229 - protein, 86 aa, Homo sapiens
FPGGGNGFQKENSCMAGSTDVVCILTHAMSRRMRVRHDSPEGLSPRRLSTAQRAGPGSGCGLGGRHTDSGTTWPWFKSHFCCSLNV

SEQ ID NO: 738230 - protein, 124 aa, Homo sapiens
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPA

SEQ ID NO: 738231 - protein, 95 aa, Homo sapiens
PGPSQKAVAGGCSEFVPLPAHCLASVLKCGGRLPRWSFSAAAIRAAWDGPGREGGRIHRSALLLLLCNQLPIWKLGRVCDWMLMSLTSFQPTIQK

SEQ ID NO: 738232 - protein, 95 aa, Homo sapiens; identical to SEQ ID NO: 738231

SEQ ID NO: 738233 - protein, 98 aa, Homo sapiens
SKLPDILKECMKLFCSEALFLLLSNFTGLKLHFLAPSEDEMDDKKEEAAASAADRTEEGTGHSPPEPENNQAAISINGQQSHEQTDRVRGLEDWSPHF

SEQ ID NO: 738234 - protein, 119 aa, Homo sapiens
MTRKAHVKRLSPACLLRAPECSSKPSSCPFRQTAASQGCLCLPEGPEVGREQKPQRVLQLSQREAATALLEACARNALLLAGGQRGEAPRLTPVILALWEAKVGGSPEIRSWKPARPTW

SEQ ID NO: 738235 - protein, 138 aa, Homo sapiens
LDHSFGIAGPSNGKGEHWMLRLLSHVRSMPGSMTSCLPFSSVKYARSESQSRIRISSKMACTGSSYHGSITRNAKQSAISELWSDLQKPRETSNTKMQIKISREINEPGRCTSVAGLAEVTTCTADCWKFCGIPAEWP

SEQ ID NO: 738236 - protein, 94 aa, Homo sapiens
LFLLCLYVCLRWSLCLCCSGQSTVVQSWLTATSTSQKKKANTANSISFLEEAGASGGWTMLELLVGGRCWSFWWVDDAESSGGWTMVELLVGGP

SEQ ID NO: 738237 - protein, 78 aa, Homo sapiens
EASLGMNGAVRRQPRLPSAGPARTTEAVCERNGNEPQALPKEPHPLPRAGLRNAGQPERNPRWERRSRASETPLRRTL

SEQ ID NO: 738238 - protein, 66 aa, Homo sapiens
CAACAPHLTNTWTSCLHPPKQDALPCQVTPSKTNWNLASYRKASVTAPGVAGLLAQGEALFEVPAL

SEQ ID NO: 738239 - protein, 112 aa, Homo sapiens
PCPANFVFLVELGFLHVGQAGLELLTSGDPPTSASESAGITGVRHRARLDSIFYMLLLLSFPTSLLSLISICPTLLLPESSSCFPVFCVFCLSLSKDRVFSVKSPTRGQTPL

SEQ ID NO: 738240 - protein, 101 aa, Homo sapiens
LLLNSRPRRPVIQTVLMQEKDKNFGNSKLGGILICPISSLFSTLALKNNSLQSQQKPAAWKPLEGSKRGWSSFKAPFPKNCHYLTYLVVPWKTLQCSLYLT

SEQ ID NO: 738241 - protein, 273 aa, Homo sapiens
APFPLFIALNTLSTLLVLSIPFLNVPTLVKAVASLHFTTASPSVSSTSRLTVHLVGRTGIYPRGPKLGFGRWITPIIDPFVEIALRVFVLRGRRNLGRALHSVLQRWGDAPGPLVAPAQVCSHGGTRVGNRFRPGQVRTRSSQRLGSRRRRLPPRAFPVTCCRAAQSAPAARGLGIQTAAPPAGGDQRWRGCGRCCLRAMEHRIVGPGPYRATRLVSECAGAWAEHPVPRAPTQRADRVLVSLRFRRPAGLGCGAFQLGLLGLPFSGRASKKG

SEQ ID NO: 738242 - protein, 728 aa, Homo sapiens
APFPLFIALNTLSTLLVLSIPFLNVPTLVKAVASLHFTTASPSVSSTSRLTVHLVGRTGIYPRGPKLGFGRWITPIIDPFVEIALRVFVLRGRRNLGRALHSVLQRWGDAPGPLVAPAKVCSHGGTRVGNRFRPGQVRTRSSQRLGSRRRRLPPRAFPVTCCRAAQSAPAARGLGIQTAAPPAGGDQRWRGCGRCCLRAMEHRIVGPGPYRATRLWNETVELFRAKMPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQIKYPGADMDITLSAPSFCRQISPEEFEYQRSYGSQEPLAALLEEVITDAKLSNKEKKKKLKQFQKSYPEVYQERFPTPESAALLFPEKPKPKPQLLMWALKKPFQPFQRTRSFRM

SEQ ID NO: 738243 - protein, 514 aa, Homo sapiens
MWNETVELFRAKMPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQIKYPGADMDITLSAPSFCRQISPEEFEYQRSYGSQEPLAALLEEVITDAKLSNKEKKKKLKQFQKSYPEVYQERFPTPESAALLFPEKPKPKPQLLMWALKKPFQPFQRTRSFRM

SEQ ID NO: 738244 - protein, 380 aa, Homo sapiens
MNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQIKYPGADMDITLSAPSFCRQISPEEFEYQRSYGSQEPLAALLEEVITDAKLSNKEKKKKLKQFQKSYPEVYQERFPTPESAALLFPEKPKPKPQLLMWALKKPFQPFQRTRSFRM

SEQ ID NO: 738245 - protein, 267 aa, Homo sapiens [sequence omitted]

SEQ ID NO: 738246 - protein, 359 aa, Homo sapiens
MVPDRSVLELLRIWPAHLMEVVPQVLVFRQAQLAKWCRYPITATMLATCVKCRKPIQSADSGCRVTTLLRIFMTSVAADLAMSSPANWAKSLRNYRTSSLSIGLNAWSNVCVGAGAPGCTCSSRLDCWRLMTPHRMRMAVPPPPPPPPPPPPPPPPPPPPAPLIRPPSTFPRPPPLCDGFGTRTLMVQTFSRCILCSKDEVDLDELLAARLVTFLMDNYQEILKVPLALQTSIEERVAHLRRVQIKYPGADMDITLSAPSFCRQISPEEFEYQRSYGSQEPLAALLEEVITDAKLSNKEKKKKLKQFQKSYPEVYQERFPTPESAALLFPEKPKPKPQLLMWALKKPFQPFQRTRSFRM

SEQ ID NO: 738247 - protein, 149 aa, Homo sapiens
FGTRVHTLLYRGLQGQRDLQTSIEERVAHLRRVQIKYPGADMDITLSAPSFCRQISPEEFEYQRSYGSQEPLAALLEEVITDAKLSNKEKKKKLKQFQKSYPEVYQERFPTPESAALLFPEKPKPKPQLLMWALKKPFQPFQRTRSFRM

SEQ ID NO: 738248 - protein, 389 aa, Homo sapiens
TRRLPGVSLPPALRRRPVHTPPPSRQLSLRACARCLPARSGSRRRAMWAAAGGLWRSRAGLRALFRSRDAALFPGCERGLHCSAVSCKNWLKKFASKTKKKVWYESPSLGSHSTYKPSKLEFLMRSTSKKTRKEDHARLRALNGLLYKALTDLLCTPEVSQELYDLNVELSKVSLTPDFSACRAYWKTTLSAEQNAHMEAVLQRSAAHMRHLLMSQQTLRNVPPIVFVQDKGNAALAELDQLLAVADFGPRDERDNFVQNDFRDPDAPQPCGTTEPTTSSSLCGIDHEALNKQIMEYKRRKDKGLGGLVWQGQVAELTTQMKKGRKRAKPRLEQDSSLKSYLSGEEVEDDLDLVGAPEYECYAPDTEELEAERGGGRTEDGHSCGASRE

SEQ ID NO: 738249 - protein, 99 aa, Homo sapiens
TRRLPGVSLPPALRRRPVHTPPPSRQLSLRACARCLPARSGSRRRAMWAAAGGLWRSRAGLRALFRSRDAALFPGCERGLHCSAVSCKNWLKKFASKTK

SEQ ID NO: 738250 - protein, 84 aa, Homo sapiens
VVGSVVPQGCGASGSLGRKKRRWQNRGWPQLRSKQGVDGEALPIPHLQGKALARNAACGFIEAVDGVKPSALLLLQHFLAFPCI

SEQ ID NO: 738251 - protein, 188 aa, Homo sapiens
MTLTWSSPRHLLMSQQTLRNVPPIVFVQDKGNAALAELDQLLAVADFGPRDERDNFVQNDFRDPDAPQPCGTTEPTTSSSLCGIDHEALNKQIMEYKRRKDKGLGGLVWQGQVAELTTQMKKGRKRAKPRLEQDSSLKSYLSGEEVEDDLDLVGAPEYECYAPDTEELEAERGGGRTEDGHSCGASRE

SEQ ID NO: 738252 - protein, 364 aa, Homo sapiens
TRRLPGVSLPPALRRRPVHTPPPSRQLSLRACARCLPARSGSRRRAMWAAAGGLWRSRAGLRALFRSRDAALFPGCERGLHCSAVSCKNWLKKFASKTKKKVWYESPSLGSHSTYKPSKLEFLMRSTSKKTRKEDHARLRALNGLLYKALTDLLCTPEVSQELYDLNVELSKVSLTPDFSACRAYWKTTLSAEQNAHMEAVLQRSAAHMRHLLMSQQTLRNVPPIVFVQDKGNAALAELDQLLAVADFGPRDERDNFVQNDFRDPDAPQPCGTTEPTTSSSLCGIDHEALNKQIMEYKRRKDKGLGGLVWQGQVAELTTQMKKGRKRAKPRLEQDSSLKSYLSGEEVEDDLDLQDNFRLQGSGT

SEQ ID NO: 738253 - protein, 210 aa, Homo sapiens
TRRLPGVSLPPALRRRPVHTPPPSRQLSLRACARCLPARSGSRRRAMWAAAGGLWRSRAGLRALFRSRDAALFPGCERGLHCSAVSCKNWLKKFASKTKKKVWYESPSLGSHSTYKPSKLEFLMRSTSKKTRKEDHARLRALNGLLYKALTDLLCTPEVSQELYDLNVELSKVSLTPDFSACRAYWKTTLSAEQNAHMEAVLQRSAAHMR

SEQ ID NO: 738254 - protein, 102 aa, Homo sapiens
HSHRHPAGHSRADPLLRGRSGGSGGAGTVATWQVTVLARRMWVCITEPTWAWGRYLGGLLEDAEVSFQEQCLAMSLVALVIMVSPETNNIQPSVSPPRHTSN

SEQ ID NO: 738255 - protein, 261 aa, Homo sapiens [sequence omitted]

SEQ ID NO: 738256 - protein, 191 aa, Homo sapiens [sequence omitted]

SEQ ID NO: 738257 - protein, 406 aa, Homo sapiens
MRESALEPGPVPEAPAGGPVHAVTVVTLLEKLASMLETLRERQGGLARRQGGLAGSVRRIQSGLGALSRSHDTTSNTLAQLLAKAERVSSHANAAQERAVRRAAQVQRLEANHGLLVARGKLHVLLFKVSDLKRSPIRGLCRPVGHQLGAPRFHPPTTPTFLTPPAVCCCGTDSQSRTHFPRPSPIPPSQPEPRLANPSPPSSSSGHVRRIWSESQPIPKITVVERAFRDCGHYPLLAPHQASPTLQRFAVRTQLSLPLPSHACLSPQTLAAEEEGEVPASAFQKAPEPLGPADQSELGPEQPEAEVGESSDEEPVESRAQRLRRTGLQKVQSLRRALSGRKGPAAPPPTPVKPPRLGPGRSAEAQPEAQPALEPTLEPEPPQDTEEDPGRPGAAEEALLQMESVA

SEQ ID NO: 738258 - protein, 293 aa, Homo sapiens [sequence omitted]

SEQ ID NO: 738259 - protein, 362 aa, Homo sapiens
AAPMRPLPPVGDVRLELSPPPPLLPVPVVSGSPVGSSGRLMASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738260 - protein, 362 aa, Homo sapiens; identical to SEQ ID NO: 738259

SEQ ID NO: 738261 - protein, 363 aa, Homo sapiens
GAEAAAGTSSGGGSGAMVKMAPPLLPVPVVSGSPVGSSGRLMASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738262 - protein, 397 aa, Homo sapiens
GAEAAAGTSSGGGSGAMVKMAPPLLPVPVVSGSPVGSSGRLMASSSSLVPDRLRLPLCFLGVFVCYFYYGILQEKMTRVGPLLVLPDACKQPIRPRPWCHSRNTVSSCLGTRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738263 - protein, 225 aa, Homo sapiens
MVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738264 - protein, 293 aa, Homo sapiens [sequence omitted]

SEQ ID NO: 738265 - protein, 353 aa, Homo sapiens
SCPQSCLIGKISRARDQSRGCRFPWPSGMEPRTRVGPLLVLPDACKQPIRPRPWCHSRNTVSSCLGTRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738266 - protein, 255 aa, Homo sapiens
MCDQCCVCQDLVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738267 - protein, 255 aa, Homo sapiens; identical to SEQ ID NO: 738266

SEQ ID NO: 738268 - protein, 198 aa, Homo sapiens
MLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738269 - protein, 180 aa, Homo sapiens
AAPMRPLPPVGDVRLELSPPPPLLPVPVVSGSPVGSSGRLMASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQGETSGWDDGWLRYHLKRTKSSSLRSVS

SEQ ID NO: 738270 - protein, 198 aa, Homo sapiens; identical to SEQ ID NO: 738268

SEQ ID NO: 738271 - protein, 216 aa, Homo sapiens
MLCLPRSVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738272 - protein, 198 aa, Homo sapiens; identical to SEQ ID NO: 738268

SEQ ID NO: 738273 - protein, 192 aa, Homo sapiens
MCDQCCVCQDLVDRTRSWLYAACSISYLGAMVSSNSALQFVNYPTQLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738274 - protein, 255 aa, Homo sapiens; identical to SEQ ID NO: 738266

SEQ ID NO: 738275 - protein, 118 aa, Homo sapiens
MLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 738276 - protein, 159 aa, Homo sapiens
AAPMRPLPPVGDVRLELSPPPPLLPVPVVSGSPVGSSGRLMASSSSLVPDRLRLPLCFLGVFVCYFYYGILQEKITRGKYGEGAKQETFTFALTLVFIQCVINAVFAKIWWIVPGAGSMLPVLSPIWVPWSPAIQHYSLSTTQLRVKPQGGMMVGSDII

SEQ ID NO: 738277 - protein, 159 aa, Homo sapiens; identical to SEQ ID NO: 738276

SEQ ID NO: 738278 - protein, 76 aa, Homo sapiens
RPIGQGWGAGALRARRVPGSCWESLFPVPPRTVRSARGGVRRARLRRAAAAADELRETEFRHVGQAHLRSLKISST

SEQ ID NO: 738279 - protein, 132 aa, Homo sapiens
MKVKIKCWNGVATWLWVANDENCGICRMAFNGCCPDCKVPGDDCPLVWGQCSHCFHMHCILKWLHAPAGAAALPHVPPGMEVQGVRPTWLSLEGHPETPSSCWRRWLLGTAPLSCNKVETRAGAAFVLPSLC

SEQ ID NO: 738280 - protein, 196 aa, Homo sapiens
MKVKIKCWNGVATWLWVANDENCGICRMAFNGCCPDCPLHGESISRCLGWCPQPVPVLGGRAHPQVPINTASPTPGQHTGSLMSREESSRSPDPTPPALDQETSSLLRCTSPWCLDHSCDLFGITDQVSADGPRACRQGARRRLPAGVGPVLPLLPHALHPQVAARTAGAAALPHVPPGMEVQGVRPDLALAGGAS

SEQ ID NO: 738281 - protein, 76 aa, Homo sapiens; identical to SEQ ID NO: 738278

SEQ ID NO: 738282 - protein, 132 aa, Homo sapiens
MSGVPWSLLVFAWGRAGQETDWVTLLISASLKHERLQCWSHCPGSLPAPLPGLSHALCPAWSCLSFSPPPLRRQGARRRLPAGVGPVLPLLPHALHPQVAARTAGAAALPHVPPGMEVQGVRPDLALAGGAS

SEQ ID NO: 738283 - protein, 210 aa, Homo sapiens
MNIYVNQRTRTTRHNQYDKYPDILNTQNSGAPTYESHPTEEGGHSFMMVSPVGGASPLMCASHQDGFCSDTEGLRPPVGGAILKKRDVRTPGHRHLLTHGATLLRWRQHNPHSTSLWWLFVTYSRDGTPHHFRLPGAARTQSMAGQSKAPTYRAREVMITAALFIGRDTSWQHSNVSKYDSFPRCSNTHPSPPPYTQCLRPAETYFSVPP

SEQ ID NO: 738284 - protein, 84 aa, Homo sapiens
MKVKIKCWNGVATWLWVANDENCGICRMAFNGCCPDCKVPGDDCPLVWGQCSHCFHMHCILKWLHAQQVQQHCPMCRQEWKFKE

SEQ ID NO: 738285 - protein, 129 aa, Homo sapiens
HITIRARTRAATVVVFIPSRADAGAANGRAGRARCVIRLAKGSAAMKVKIKCWNGVATWLWVANDENCGICRMAFNGCCPDCKVPGDDCPLVWGQCSHCFHMHCILKWLHAQQVQQHCPMCRQEWKFKE

SEQ ID NO: 738286 - protein, 84 aa, Homo sapiens; identical to SEQ ID NO: 738284

SEQ ID NO: 738287 - protein, 145 aa, Homo sapiens
MKVKIKCWNGVATWLWVANDENCGICRMAFNGCCPDCWSAMARSRLAATSASRVQTVLLPQPSKQLGLQARCPATTARWCGASAPTASTCIASSSGCTHSRCSSTAPCAARNGSSRSEARPGSRWRGILRLLPHAGADGCWGQRP

SEQ ID NO: 738288 - protein, 106 aa, Homo sapiens
MPQREGSAAMKVKIKCWNGVATWLWVANDENCGICRMAFNGCCPDCECPLHAVLSGPDCKVPGDDCPLVWGQCSHCFHMHCILKWLHAQQVQQHCPMCRQEWKFKE

SEQ ID NO: 738289 - protein, 196 aa, Homo sapiens; identical to SEQ ID NO: 738280

SEQ ID NO: 738290 - protein, 42 aa, Homo sapiens
NISVKRQGPRQTLSHDWEEKEQDQTVEPGACSSGMLLPAGLP

SEQ ID NO: 738291 - protein, 132 aa, Homo sapiens; identical to SEQ ID NO: 738279

SEQ ID NO: 738292 - protein, 132 aa, Homo sapiens; identical to SEQ ID NO: 738279

SEQ ID NO: 738293 - protein, 84 aa, Homo sapiens; identical to SEQ ID NO: 738284

SEQ ID NO: 738294 - protein, 132 aa, Homo sapiens; identical to SEQ ID NO: 738279

SEQ ID NO: 738295 - protein, 432 aa, Homo sapiens
AEAAGVRRWAGLPRPALRRGGGWARGERDGAGAVRPRRRCLGGRVGCRTGGTAEAVGPRPARQVWKPPLRPVRADREAAGGWRRVSGTMKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPELPTIPEGGCFDESESEDSCEDMSCGEESLSSSPPSDQECTFFFNFKVAQTLCFPS

SEQ ID NO: 738296 - protein, 344 aa, Homo sapiens
MKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPELPTIPEGGCFDESESEDSCEDMSCGEESLSSSPPSDQECTFFFNFKVAQTLCFPS

SEQ ID NO: 738297 - protein, 432 aa, Homo sapiens; identical to SEQ ID NO: 738295

SEQ ID NO: 738298 - protein, 432 aa, Homo sapiens; identical to SEQ ID NO: 738295

SEQ ID NO: 738299 - protein, 412 aa, Homo sapiens
KKKQHQLEAGCSLACVLRSSASVSLPDNPGSNACGAAHCPQTFCTCVTPVTSSVSRFPDFSAPPLQQQMKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPELPTIPEGGCFDESESEDSCEDMSCGEESLSSSPPSDQECTFFFNFKVAQTLCFPS

SEQ ID NO: 738300 - protein, 432 aa, Homo sapiens; identical to SEQ ID NO: 738295

SEQ ID NO: 738301 - protein, 432 aa, Homo sapiens; identical to SEQ ID NO: 738295

SEQ ID NO: 738302 - protein, 420 aa, Homo sapiens
AEAAGVRRWAGLPRPALRRGGGWARGERDGAGAVRPRRRCLGGRVGCRTGGTAEAVGPRPARQVWKPPLRPVRADREAAGGWRRVSGTMKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPELPTIPEGGCFDESERFQYGVPATSHLPPPSSHMQIVSLLRQPT

SEQ ID NO: 738303 - protein, 392 aa, Homo sapiens
AEAAGVRRWAGLPRPALRRGGGWARGERDGAGAVRPRRRCLGGRVGCRTGGTAEAVGPRPARQVWKPPLRPVRADREAAGGWRRVSGTMKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPELPTIPEGGCFDESER

SEQ ID NO: 738304 - protein, 420 aa, Homo sapiens; identical to SEQ ID NO: 738302

SEQ ID NO: 738305 - protein, 412 aa, Homo sapiens
AEAAGVRRWAGLPRPALRRGGGWARGERDGAGAVRPRRRCLGGRVGCRTGGTAEAVGPRPARQVWKPPLRPVRADREAAGGWRRVSGTMKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPERVLTTTWHRGQSLMTCQIELLMMPHEDSLQQTILN

SEQ ID NO: 738306 - protein, 399 aa, Homo sapiens
MQSLSLGQTSISKGLNYLTIMAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVNILERSPESFFRSNNNLNLENNIKFLYSVGLTRKCLCRLLTNAPRTFSNSLDLNKQMVEFLQAAGLSLGHNDPADFVRKIIFKNPFILIQSTKRVKANIEFLRSTFNLNSEELLVLICGPGAEILDLSNDYARRSYANIKEKLFSLGCTEEEVQKFVLSYPDVIFLAEKKFNDKIDCLMEENISISQIIENPRVLDSSISTLKSRIKELVNAGCNLSTLNITLLSWSKKRYEAKLKKLSRFA

SEQ ID NO: 738307 - protein, 399 aa, Homo sapiens; identical to SEQ ID NO: 738306

SEQ ID NO: 738308 - protein, 109 aa, Homo sapiens [sequence omitted]

SEQ ID NO: 738309 - protein, 128 aa, Homo sapiens
EAAGPQLRGRRKVLLDTFEYPGLVHHTGGCHCGAVRFAVWAPADLRVVDCSCRLCRKKQHRHFLVPASRFTLLQGAESIVTYRSNTHPALHSFCSRCGVQSFHAAVFDPRVYGVAPHCLDEGTVRSVV

SEQ ID NO: 738310 - protein, 78 aa, Homo sapiens
ERSLGRPHPSSHTQLLTVWYVGIFCPTAACAFAEHLQESHVGDGLDVAGTRAELLRFSECGQTRCSDMALGGVGTQAG

SEQ ID NO: 738311 - protein, 143 aa, Homo sapiens [sequence omitted]

SEQ ID NO: 738312 - protein, 124 aa, Homo sapiens
CASCSDLPPTPPPPQTEGKCEGTSSGKKLDLQEERGALLKMEIALLQFAGYTRSLSLSPPTSSFSSSKFVPVQCLHRAGLKLWQTRIHCIHFFPLVLVWFSGMKEASCFTNLFAFLMWFLSDFY

SEQ ID NO: 738313 - protein, 239 aa, Homo sapiens
MPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKVLPEAGAGEDSPGRNMDTALEELQLPPNAEGHVKQVSPRRPQATEAVGRPTGPAGLRRTPNKQPSDHSYALLDLDSLKKKLFLTLKENEKLRKRLQAQRLVMRRMSSRLRACKGHQGLQARLGPEQQS

SEQ ID NO: 738314 - protein, 249 aa, Homo sapiens
QLSREVLCSDVKIPNDSEALGPALLGLTPRASALRFPFSRPELLKEWVLNIGRGNFKPKQHTVICSEHFRPECFSAFGNRKNLKHNAVPTVFAFQDPTQQVRENTDPASERGNASSSQKEKVLPEAGAGEDSPGRNMDTALEELQLPPNAEGHVKQVSPRRPQATEAVGRPTGPAGLRRTPNKQPSDHSYALLDLDSLKKKLFLTLKENEKLRKRLQAQRLVMRRMSSRLRACKGHQGLQARLGPEQQS

SEQ ID NO: 738315 - protein, 279 aa, Homo sapiens
MSAPWRRARPVTTSQRPRPSPQVPPLSAGPAAAAIFVGGSQAWLEMPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKVLPEAGAGEDSPGRNMDTALEELQLPPNAEGHVKQVRLSAKVVCGWTQDDLLQTKWKPVSTHHETCVAEAGCAAWVSELPSQILHHGVGTSGFWGSSPECLAALGLCCVRVWWPAHHGPPSCW

SEQ ID NO: 738316 - protein, 239 aa, Homo sapiens; identical to SEQ ID NO: 738313

SEQ ID NO: 738317 - protein, 239 aa, Homo sapiens; identical to SEQ ID NO: 738313

SEQ ID NO: 738318 - protein, 807 aa, Homo sapiens
FPEITTRSNQSRVVPGAGAGQLSPAQPGPAQSPRRPRAQSRVPLAVRRTGSPEEQLLRPPPGSSVHRARRRPGRGSEPRAPGPGPGPRAPGPDVPMREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRYKFHNSRWMVAGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARAEEKSCAADSDPEPERLSEERAGAPLGRSPAPDSASPTRLTEPERARERRSPERGKEPAESGGDGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 738319 - protein, 807 aa, Homo sapiens; identical to SEQ ID NO: 738318

SEQ ID NO: 738320 - protein, 147 aa, Homo sapiens [sequence omitted]

SEQ ID NO: 738321 - protein, 489 aa, Homo sapiens
FPEITTRSNQSRVVPGAGAGQLSPAQPGPAQSPRRPRAQSRVPLAVRRTGSPEEQLLRPPPGSSVHRARRRPGRGSEPRAPGPGPGPRAPGPDVPMREPALAASAMAYHPFHAPRPADFPMSAFLAAAQPSFFPALALPPGALAKPLPDPGLAGAAAAAAAAAAAAEAGLHVSALGPHPPAAHLRSLKSLEGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 738322 - protein, 379 aa, Homo sapiens
FPEITTRSNQSRVVPGAGAGQLSPAQPGPAQSPRRPRAQSRVPLAVRRTGSPEEQLLRPPPGSSVHRARRRPGRGSEPRAPGPGPGPRAPGPDVPMREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRTSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 738323 - protein, 648 aa, Homo sapiens
PRAGGATAAGGNARERDRTQSVNTAFTALRTLIPTEPVDRKLSKIETLRLASSYIAHLANVLLLGDSGRRRAAVLPLPLGSCQGLPSPPAADGGRQPRSICTVLPQQPAQGGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARAEEKSCAADSDPEPERLSEERAGAPLGRSPAPDSASPTRLTEPERARERRSPERGKEPAESGGDGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 738324 - protein, 242 aa, Homo sapiens
FPEITTRSNQSRVVPGAGAGQLSPAQPGPAQSPRRPRAQSRVPLAVRRTGSPEEQLLRPPPGSSVHRARRRPGRGSEPRAPGPGPGPRAPGPDVPMREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEPLPGQCPAPTAFQPLSDPGHHPA

SEQ ID NO: 738325 - protein, 198 aa, Homo sapiens
FGGSLHLCLSKAPANGGVDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 738326 - protein, 345 aa, Homo sapiens
FPEITTRSNQSRVVPGAGAGQLSPAQPGPAQSPRRPRAQSRVPLAVRRTGSPEEQLLRPPPGSSVHRARRRPGRGSEPRAPGPGPGPRAPGPDVPMREPALAASAMAYHPFHAPRPADFPMSAFLAAAQPSFFPALALPPGALAKPLPDPGLAGAAAAAAAAAAAAEAGLHVSALGPHPPAAHLRSLKSLEAGSRPSEGLPSCSPATQATRAACPCCLGRVQHRMSIYLNKGEKWAAAAGIEPRLASRGLGHFPGPQQGSGCWKHSHLGAAGLGPDPLQRQGGIRRCLWSSSEVGEASSRAQRSLQKPEGAGARGGSIGGSPRALDLGPRPRDKTGLRDAGTSYD

SEQ ID NO: 738327 - protein, 89 aa, Homo sapiens
HVHAHPHPRACIPCCFPGRHTGAHESLLASLQGGDPQNPAPGPNLGKKLLLCQQLLFGLRHSHLDPTLSRLLLLLPGRGSSKRRLVKTH

SEQ ID NO: 738328 - protein, 730 aa, Homo sapiens [sequence omitted]

SEQ ID NO: 738329 - protein, 730 aa, Homo sapiens [sequence omitted]

SEQ ID NO: 738330 - protein, 69 aa, Homo sapiens
HVAWGKISTLHAGCLDINSMLLAGQGGNGMRQALLAAWELGEACHCQLFLAFLGALYEAAKAAITSLKT

SEQ ID NO: 738331 - protein, 112 aa, Homo sapiens
MDEPSPLAQPLELNQHSRFIIGSVSEDNSEDEISNLVKLDLLEEKEGSLSPASVGSDTLSDLGISSLQDGLALHISSWIKRSGSVVLGSHCSSESPRGALGDKPHPQRFRFI

SEQ ID NO: 738332 - protein, 2346 aa, Homo sapiens
MDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 738333 - protein, 2411 aa, Homo sapiens
GPAWCCTPVSHRPSRRRLLPPSSSSTQGLRNRPTAHVATLRSFWKWISTQTVRIIRAVRAHFGGIMDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 738334 - protein, 2346 aa, Homo sapiens; identical to SEQ ID NO: 738332

SEQ ID NO: 738335 - protein, 2346 aa, Homo sapiens; identical to SEQ ID NO: 738332

SEQ ID NO: 738336 - protein, 1156 aa, Homo sapiens
MNVIELPFRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 738337 - protein, 472 aa, Homo sapiens [sequence omitted]

SEQ ID NO: 738338 - protein, 353 aa, Homo sapiens
MSTPPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 738339 - protein, 1784 aa, Homo sapiens
MDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRMPTLS

SEQ ID NO: 738340 - protein, 174 aa, Homo sapiens [sequence omitted]

SEQ ID NO: 738341 - protein, 174 aa, Homo sapiens [sequence omitted]

SEQ ID NO: 738342 - protein, 174 aa, Homo sapiens [sequence omitted]

SEQ ID NO: 738343 - protein, 174 aa, Homo sapiens [sequence omitted]

SEQ ID NO: 738344 - protein, 2342 aa, Homo sapiens
MDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKVHFSVSYMVMRYGSRLWKLRVLQAELKINIRLTPTGKAIPIRLFLTNESGYYLDISLYKEVTDSRQHRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEAIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGGVLEPEGTVEIKFRKEDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 738345 - protein, 733 aa, Homo sapiens
MDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDR

SEQ ID NO: 738346 - protein, 85 aa, Homo sapiens
NLTLLQSFLLVPFPYCYFPSPCSYPPCLMNVIELPFRMSFSSNLNHYGMTHVASVSDVLLDNSFTPPCQRMGGMVSFRTFEDFVR

SEQ ID NO: 738347 - protein, 507 aa, Homo sapiens
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEDKVANIWCSFNVFLKIKDILPRHIQLIMSFCFTFLSLLPACIKLILQPSSKGFKFTLVSCALSFFLFSFQVHEKSILLVSLPVCLVLSEIPFMSTWFLLVSTFSMLPLLLKDELLMPSVVTTMAFFIACVTSFSIFEKTSEEELQLKSFSISVRKYLPCFTFLSRIIQYLFLISVITMVLLTLMTVTLDPPQKLPDLFSVLVCFVSCLNFLFFLVYFNIIIMWDSKSGRNQKKIS

SEQ ID NO: 738348 - protein, 507 aa, Homo sapiens; identical to SEQ ID NO: 738347

SEQ ID NO: 738349 - protein, 507 aa, Homo sapiens; identical to SEQ ID NO: 738347

SEQ ID NO: 738350 - protein, 507 aa, Homo sapiens; identical to SEQ ID NO: 738347

SEQ ID NO: 738351 - protein, 474 aa, Homo sapiens
MFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEDKVANIWCSFNVFLKIKDILPRHIQLIMSFCFTFLSLLPACIKLILQPSSKGFKFTLVSCALSFFLFSFQVHEKSILLVSLPVCLVLSEIPFMSTWFLLVSTFSMLPLLLKDELLMPSVVTTMAFFIACVTSFSIFEKTSEEELQLKSFSISVRKYLPCFTFLSRIIQYLFLISVITMVLLTLMTVTLDPPQKLPDLFSVLVCFVSCLNFLFFLVYFNIIIMWDSKSGRNQKKIS

SEQ ID NO: 738352 - protein, 443 aa, Homo sapiens
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEDKVANIWCSFNVFLKIKDILPRHIQLIMSFCFTFLSLLPACIKLILQPSSKGFKFTLVSCALSFFLFSFQVHEKSILLVSLPVCLVLSEIPFMSTWFLLVSTFSMLPLLLKDELLMPSVVTTMAFFIACVTSFSIFEKTSEEELQLKSFSISVRKYLPCFTFLSRIIQYLF

SEQ ID NO: 738353 - protein, 104 aa, Homo sapiens
YLLFHSETTSLDGLIRQWKDNLKFLQRAVEMQEPSPTHFMMPENLDTKTWQKLYEKGTVFHSPQHQCKNPKQNTSKLNYAHTHATHTHTHTHTHTNPSVFLCMW

SEQ ID NO: 738354 - protein, 116 aa, Homo sapiens
SHPNLYTTLLCGRFHMALRTSSTLLKGVPDPDKTKNQCQPLGKWRPRQEVRRFLRSAFWVEEQGLKPRSSGTEVWLPRKYGSPPEVTCAPGCGPAPPTTPFVTPGTSLTPGASGWR

SEQ ID NO: 738355 - protein, 79 aa, Homo sapiens
NLLPDSLLSPRMAVWELEAAVLPVFLGHLVADFKHLILDVYLTILFRHLGILALRNILRILLIRNPKCSLREEKYIRRE

SEQ ID NO: 738356 - protein, 75 aa, Homo sapiens
GGGGGGGDGREGSVGGRRSLRQKEALGPRPDRDLARRDRPRARDPTPTHSSIYPLPAPPPPTLSRAAEDDKHPGQ

SEQ ID NO: 738357 - protein, 75 aa, Homo sapiens; identical to SEQ ID NO: 738356

SEQ ID NO: 738358 - protein, 69 aa, Homo sapiens
IYGLGSEAWVLRSLRQKEALGPRPDRDLARRDRPRARDPTPTHSSIYPLPAPPPPTLSRAAEDDKHPGQ

SEQ ID NO: 738359 - protein, 75 aa, Homo sapiens; identical to SEQ ID NO: 738356

SEQ ID NO: 738360 - protein, 75 aa, Homo sapiens; identical to SEQ ID NO: 738356

SEQ ID NO: 738361 - protein, 75 aa, Homo sapiens; identical to SEQ ID NO: 738356

SEQ ID NO: 738362 - protein, 205 aa, Homo sapiens
GGGGGGGDGREGSVGGRRSLRQKEALGPRPDRDLARRDRPRARDPTPTHSSIYPLPAPPPPTLSRAAEDDKHPGQDEKLTVTQDLPVNDGKPHIVHFQYEVTEVKVSSWDAVLSSQSLFVEIPDGLLADGSKEGLLALLEFAEEKMKVNYVFICFRKGREDRAPLLKTFSFLGFEIVRPGHPCVPSRPDVMFMVYPLDQNLSDED

SEQ ID NO: 738363 - protein, 75 aa, Homo sapiens; identical to SEQ ID NO: 738356

SEQ ID NO: 738364 - protein, 87 aa, Homo sapiens
GGGGGGGGGREGSVGGRRSLRQKEALGPRPDRDLARRDRPRARDPTPTHSSIYPLPAPPPPTLSRAAEDDKHPGQSLVLFWHLVKLA

SEQ ID NO: 738365 - protein, 205 aa, Homo sapiens; identical to SEQ ID NO: 738362

SEQ ID NO: 738366 - protein, 78 aa, Homo sapiens
GGGGGGGDGREGSVGGRRSLRQKEALGPRPDRDLARRDRPRARDPTPTHSSIYPLPAPPPPTLSRAAEDDKHPGQGLG

SEQ ID NO: 738367 - protein, 75 aa, Homo sapiens; identical to SEQ ID NO: 738356

SEQ ID NO: 738368 - protein, 117 aa, Homo sapiens
GESSNSIKNQELPLRTTWDFWRKMYLREPQNYQSRCQQIDVKNKLCKCDHCVRQRIAHQHDDHGVHKREKAFSHNNCGKDCVKESSQHSIIQSGEQTSDENGKGLSVGSNLELHQQL

SEQ ID NO: 738369 - protein, 493 aa, Homo sapiens
TSHSQFHRSILGPTAALSSESRASAEQSGRRTPGAGADGTRGMNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 738370 - protein, 452 aa, Homo sapiens
TSHSQFHRSILGPTAALSSESRASAEQSGRRTPGAGADGTRGMNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVLRSLA

SEQ ID NO: 738371 - protein, 177 aa, Homo sapiens
LALSVSPLDLGTHRCPQLRVQGEAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGKEDTSAGNRRANC

SEQ ID NO: 738372 - protein, 420 aa, Homo sapiens
TSHSQFHRSILGPTAALSSESRASAEQSGRRTPGAGADGTRGMNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSGKAPRYLLEWRW

SEQ ID NO: 738373 - protein, 75 aa, Homo sapiens
IHALNTTEGRSFMHINNANFSKDSGITYLGIKANEVQEFNLSTYFERATDFTDQALAQNGQVLVQCWEGYSHLQL

SEQ ID NO: 738374 - protein, 76 aa, Homo sapiens
VLKQQNLPPQPRGILPGTPEEMRASLAELGEVQGPHLDLPSSPEGAEQNWCSGAHGLRSLKQLLLQPCGTELIQQA

SEQ ID NO: 738375 - protein, 275 aa, Homo sapiens
MPLLWITGPRYHLILLSEASCLRANYVHLCPLFQHRWLETCNAPPQLIQGKARSAPKPSQASGHFSVELVRGYAGFGLTLGGGRDVAGDTPLAVRGLLKDGPAQRCGRLEVGDLVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 738376 - protein, 275 aa, Homo sapiens; identical to SEQ ID NO: 738375

SEQ ID NO: 738377 - protein, 280 aa, Homo sapiens
AWGVSSYCPVLAVSVLDSADIEVTDSRLPHATIVDHRPQHRWLETCNAPPQLIQGKARSAPKPSQASGHFSVELVRGYAGFGLTLGGGRDVAGDTPLAVRGLLKDGPAQRCGRLEVGDLVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 738378 - protein, 275 aa, Homo sapiens; identical to SEQ ID NO: 738375

SEQ ID NO: 738379 - protein, 326 aa, Homo sapiens
RLQQSEAKHSSWLLQPGLLAGLPGRGPSPLAGPSARQLLARLDARPLAARAAVDVAALVRRAGATLRLRRKEAVSVLDSADIEVTDSRLPHATIVDHRPQGKARSAPKPSQASGHFSVELVRGYAGFGLTLGGGRDVAGDTPLAVRGLLKDGPAQRCGRLEVGDLVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 738380 - protein, 206 aa, Homo sapiens
MSPNSPLHCFYLPAVSVLDSADIEVTDSRLPHATIVDHRPQVGDLVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 738381 - protein, 117 aa, Homo sapiens [sequence omitted]

SEQ ID NO: 738382 - protein, 263 aa, Homo sapiens
GRLLAMEPRTGGAANPKGSRGSRGPSPLAGPSARQLLARLDARPLAARAAVDVAALVRRAGATLRLRRKEAVSVLDSADIEVTDSRLPHATIVDHRPQVGDLVLHINGESTQGLTHAQAVERIRAGGPQLHLVIRRPLETHPGKPRGVGEPRKGVVPSWPDRSPDPGGPEVTGSRSSSTSLVQHPPSRTTLKKTRGSPEPSPEAAADGPTVSPPERRAEDPNDQIPGSPGPWLVPSEERLSRALGVRGAAQLAQEMAAGRRRH

SEQ ID NO: 738383 - protein, 533 aa, Homo sapiens
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETFVDMEPIHMDFLRSLAFQGPHLCFFWELLCPTIR

SEQ ID NO: 738384 - protein, 503 aa, Homo sapiens
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 738385 - protein, 485 aa, Homo sapiens
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 738386 - protein, 442 aa, Homo sapiens
MECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 738387 - protein, 229 aa, Homo sapiens
MIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 738388 - protein, 267 aa, Homo sapiens
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKR

SEQ ID NO: 738389 - protein, 1460 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSLEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLG

SEQ ID NO: 738390 - protein, 1552 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSLEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKR

SEQ ID NO: 738391 - protein, 1582 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSLEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLFWRLGSPRAWSQHLVRAFMLHHPVTEVEGQNAIVIHEVYEEGAAARDGRLWAGDQILEVNGVDLRNSSHEEAITALRQTPQKVRLVVYRDEAHYRDEENLEIFPVDLQKKAGRGLGLSIVGKR

SEQ ID NO: 738392 - protein, 1300 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLETLTQNRIYSHP

SEQ ID NO: 738393 - protein, 1385 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSLEVGIKQLPESESFKLEDMSQAIGQM

SEQ ID NO: 738394 - protein, 1145 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVNDVKVLFLLETYGKTVK

SEQ ID NO: 738395 - protein, 1098 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRMYVDDIIVAFSIGAQPVALFFNLTEHYLVLL

SEQ ID NO: 738396 - protein, 993 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVGLSLSPRLECSAVAYSWLTAASTSQAPWILSPRLPELLGPQACTTMPG

SEQ ID NO: 738397 - protein, 988 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGL

SEQ ID NO: 738398 - protein, 675 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEADHMSHPKSHTACQV

SEQ ID NO: 738399 - protein, 183 aa, Homo sapiens
MTKIKADPDGPEAQAEACSGERTYQELLVNQNPIAQPLASRRLTRKLYKCIKKAVKQKQIRRGVKEVQKFVNKGEKGIMVLAGDTLPIEVYCHLPVMCEDRNLPYVYIPSKTDLGAAAGSKRPTCVIMVKPHEEYQEAYDECLEEGAVPAPTPMRGSGSTWAPAAGSYWAGSRTTGCPPAHPH

SEQ ID NO: 738400 - protein, 183 aa, Homo sapiens; identical to SEQ ID NO: 738399

SEQ ID NO: 738401 - protein, 183 aa, Homo sapiens; identical to SEQ ID NO: 738399

SEQ ID NO: 738402 - protein, 183 aa, Homo sapiens; identical to SEQ ID NO: 738399

SEQ ID NO: 738403 - protein, 183 aa, Homo sapiens; identical to SEQ ID NO: 738399

SEQ ID NO: 738404 - protein, 183 aa, Homo sapiens; identical to SEQ ID NO: 738399

SEQ ID NO: 738405 - protein, 183 aa, Homo sapiens; identical to SEQ ID NO: 738399

SEQ ID NO: 738406 - protein, 183 aa, Homo sapiens; identical to SEQ ID NO: 738399

SEQ ID NO: 738407 - protein, 183 aa, Homo sapiens; identical to SEQ ID NO: 738399

SEQ ID NO: 738408 - protein, 183 aa, Homo sapiens; identical to SEQ ID NO: 738399

SEQ ID NO: 738409 - protein, 183 aa, Homo sapiens; identical to SEQ ID NO: 738399

SEQ ID NO: 738410 - protein, 183 aa, Homo sapiens; identical to SEQ ID NO: 738399

SEQ ID NO: 738411 - protein, 187 aa, Homo sapiens
AAAETKSQGGEPTRSTAQAEACSGERTYQELLVNQNPIAQPLASRRLTRKLYKCIKKAVKQKQIRRGVKEVQKFVNKGEKGIMVLAGDTLPIEVYCHLPVMCEDRNLPYVYIPSKTDLGAAAGSKRPTCVIMVKPHEEYQEAYDECLEEGAVPAPTPMRGSGSTWAPAAGSYWAGSRTTGCPPAHPH

SEQ ID NO: 738412 - protein, 186 aa, Homo sapiens
MTKIKADPDGPEAQAEACSGERTYQELLVNQNPIAQPLASRRLTRKLYKCIKKAVKQKQIRRGVKEVQKFVNKGEKGIMVLAGDTLPIEVYCHLPVMCEDRNLPYVYIPSKTDLGAAAGSKRPTCVIMVKPHEEYQEAYDECLEEGAVPAPTKPHSLASLGSGEGWAWPRWKVDCWLAGLRVCGTC

SEQ ID NO: 738413 - protein, 274 aa, Homo sapiens
MTKIKADPDGPEAQAEACSGERTYQELLVNQNPIAQPLASRRLTRKLYKCIKKARASQHKGPRTIGAGAATEVQTHTFVQPHKGGQNHRGRSTAGYYGPRDDQPTLAPTLQRLNFQPGGATIVHTRSRCPFGLATVTPRDDTGACGPPESAVHSRSTRRSLEETPGNPYGGLLAKWRPAEGDLPNTGSTTPTEHDGTWRIGRNFTARLAAVPREALPAPNCTRHGLARKAGTKAGPLATPGSWTASAPWANSQRAGKRYPSVSPGSDPLIEAGR

SEQ ID NO: 738414 - protein, 136 aa, Homo sapiens
EAAVNSLVNLYLQASYTYLSLGFYFDRDDVALEGVHFFRELAEEKREGYERLLKMQNQRGGRALFQDIKKPAEDEWGKTQAMKAAMALGEKAEPGPFGSSCPGVLPARTPIFCDFLETHFLDEEVKLIKKMGDHLT

SEQ ID NO: 738415 - protein, 109 aa, Homo sapiens
MAHAFQSHIIAVEIEAHTEEGYERLLKMQNQRGGRALFQDIKKPAEDEWGKTQAMKAAMALEKKLNQALLDLHALGFCPHGPPSSVDFLETHFLDEEVKLIKKMGDHLT

SEQ ID NO: 738416 - protein, 162 aa, Homo sapiens
PSSRWPWLAHNFLKPSSPAPAQASRWPLQAQLLPSDSVSRPRTASSRWIPLCPAWASRQPLLAQIVLKSPSPGPAPASRQPLQAQRVVNEGPSGVSSCLSSASRGQSGGLCRPRLPLSQALQGQLQPPGRLCRPKSSSSRPGSGPGRAAFWPPRAQLRPLGG

SEQ ID NO: 738417 - protein, 81 aa, Homo sapiens
MNDYKLEEDPVTKERTFKRFAPRKGDKIYQEFKKLYFYSDAYRPLKFACETIIEEYEDEISSLIAQETHYLADKLCSEKSG

SEQ ID NO: 738418 - protein, 93 aa, Homo sapiens
INPSLKAGPSSQVQSLLLFELLCQDWFRAEAIGDDILSAAGQGCGPNMAALAINLPKPEGHSDPDKQKTYPAIKIVRWPGGVAHAYNPSTLGG

SEQ ID NO: 738419 - protein, 1360 aa, Homo sapiens
RSQSSDNYLPVSLRSEVPGVRGPQPVTMTADKLVFFVNGRKVVEKNADPETTLLAYLRRKLGLSGTKLGCGEGGCGACTVMLSKYDRLQNKIVHFSANACLAPICSLHHVAVTTVEGIGSTKTRLHPVQERIAKSHGSQCGFCTPGIVMSMYTLLRNQPEPTMEEIENAFQGNLCRCTGYRPILQGFRTFARDGGCCGGDGNNPNCCMNQKKDHSVSLSPSLFKPEEFTPLDPTQEPIFPPELLRLKDTPRKQLRFEGERVTWIQASTLKELLDLKAQHPDAKLVVGNTEIGIEMKFKNMLFPMIVCPAWIPELNSVEHGPDGISFGAACPLSIVEKTLVDAVAKLPAQKTEVFRGVLEQLRWFAGKQVKSVASVGGNIITASPISDLNPVFMASGAKLTLVSRGTRRTVQMDHTFFPGYRKTLLSPEEILLSIEIPYSREGEYFSAFKQASRREDDIAKVTSGMRVLFKPGTTEVQELALCYGGMANRTISALKTTQRQLSKLWKEELLQDVCAGLAEELHLPPDAPGGMVDFRCTLTLSFFFKFYLTVLQKLGQENLEDKCGKLDPTFASATLLFQKDPPADVQLFQEVPKGQSEEDMVGRPLPHLAADMQASGEAVYCDDIPRYENELSLRLVTSTRAHAKIKSIDTSEAKKVPGFVCFISADDVPGSNITGICNDETVFAKDKVTCVGHIIGAVVADTPEHTQRAAQGVKITYEELPAIITIEDAIKNNSFYGPELKIEKGDLKKGFSEADNVVSGEIYIGGQEHFYLETHCTIAVPKGEAGEMELFVSTQNTMKTQSFVAKMLGVPANRIVVRVKRMGGGFGGKETRSTVVSTAVALAAYKTGRPVRCMLDRDEDMLITGGRHPFLARYKVGFMKTGTVVALEVDHFSNVGNTQDLSQSIMERALFHMDNCYKIPNIRGTGRLCKTNLPSNTAFRGFGGPQGMLIAECWMSEVAVTCGMPAEEVRRKNLYKEGDLTHFNQKLEGFTLPRCWEECLASSQYHARKSEVDKFNKENCWKKRGLCIIPTKFGISFTVPFLNQAGALLHVYTDGSVLLTHGGTEMGQGLHTKMVQVASRALKIPTSKIYISETSTNTVPNTSPTAASVSADLNGQAVYAACQTILKRLEPYKKKNPSGSWEDWVTAAYMDTVSLSATGFYRTPNLGYSFETNSGNPFHYFSYGVACSEVEIDCLTGDHKNLRTDIVMDVGSSLNPAIDIGQVEGAFVQGLGLFTLEELHYSPEGSLHTRGPSTYKIPAFGSIPIEFRVSLLRDCPNKKAIYASKAVGEPPLFLAASIFFAIKDAIRAARAQHTGNNVKELFRLDSPATPEKIRNACVDKFTTLCVTGVPENCKPWSVRV

SEQ ID NO: 738420 - protein, 1153 aa, Homo sapiens [sequence omitted]

SEQ ID NO: 738421 - protein, 74 aa, Homo sapiens
EEPQGQTNPPSADLNTVGEGGIWVPIQVFLGSTKSFSYGVRTTQTVWHSQAVKMPTSVQQPTHSPEPSHYGSQC

SEQ ID NO: 738422 - protein, 635 aa, Homo sapiens
MNQKKDHSVSLSPSLFKPEEFTPLDPTQEPIFPPELLRLKDTPRKQLRFEGERVTWIQASTLKELLDLKAQHPDAKLVVGNTEIGIEMKFKNMLFPMIVCPAWIPELNSVEHGPDGISFGAACPLSIVEKTLVDAVAKLPAQKTEVFRGVLEQLRWFAGKQVKSVASVGGNIITASPISDLNPVFMASGAKLTLVSRGTRRTVQMDHTFFPGYRKTLLSPEEILLSIEIPYSREGEYFSAFKQASRREDDIAKVTSGMRVLFKPGTTEVQELALCYGGMANRTISALKTTQRQLSKLWKEELLQDVCAGLAEELHLPPDAPGGMVDFRCTLTLSFFFKFYLTVLQKLGQENLEDKCGKLDPTFASATLLFQKDPPADVQLFQEVPKGQSEEDMVGRPLPHLAADMQASGEAVYCDDIPRYENELSLRLVTSTRAHAKIKSIDTSEAKKVPGFVCFISADDVPGSNITGICNDETVFAKDKVTCVGHIIGAVVADTPEHTQRAAQGVKITYEELPAIITIEDAIKNNSFYGPELKIEKGDLKKGFSEADNVVSGEIYIGGQEHFYLETHCTIAVPKGEAGEMELFVSTQNTMKTQSFVAKMLGVPANRIVVRVKRMGGRSYMQPGPHAVTPQCSGL

SEQ ID NO: 738423 - protein, 679 aa, Homo sapiens
APCSLTELHFPTLPTRPVTLCGPRARSRVSTAAPHFLGPGPGPSPRLRHGSTMEEADRILIHSLRQAGTAVPPDVQTLRAFTTELVVEAVVRCLRVINPAVGSGLSPLLPLAMSARFRLAMSLAQACMDLGYPLELGYQNFLYPSEPDLRDLLLFLAERLPTDASEDADQPAGDSAILLRAIGSQIRDQLALPWVPPHLRTPKLQHLQGSALQKPFHASRLVVPELSSRGEPREFQASPLLLPVPTQVPQPVGRVASLLEHHALQLCQQTGRDRPGDEDWVHRTSRLPPQEDTRAQRQRLQKQLTEHLRQSWGLLGAPIQARDLGELLQAWGAGAKTGAPKGSRFTHSEKFTFHLEPQAQATQVSDVPATSRRPEQVTWAAQEQELESLREQLEGVNRSIEEVEADMKTLGVSFVQAESECRHSKLSTAEREQALRLKSRAVELLPDGTANLAKLQLVVENSAQRVIHLAGQWEKHRVPLLAEYRHLRKLQDCRELESSRRLAEIQELHQSVRAAAEEARRKEEVYKQLMSELETLPRDVSRLAYTQRILEIVGNIRKQKEEITKILSDTKELQKEINSLSGKLDRTFAVTDELVFKDAKKDDAVRKAYKYLAALHENCSQLIQTIEDTGTIMREVRDLEEQIETELGKKTLSNLEKIREDYRALRQENAGLLGRVREA

SEQ ID NO: 738424 - protein, 869 aa, Homo sapiens
APCSLTELHFPTLPTRPVTLCGPRARSRVSTAAPHFLGPGPGPSPRLRHGSTMEEADRILIHSLRQAGTAVPPDVQTLRAFTTELVVEAVVRCLRVINPAVGSGLSPLLPLAMSARFRLAMSLAQACMDLGYPLELGYQNFLYPSEPDLRDLLLFLAERLPTDASEDADQPAGDSAILLRAIGSQIRDQLALPWVPPHLRTPKLQHLQGSALQKPFHASRLVVPELSSRGEPREFQASPLLLPVPTQVPQPVGRVASLLEHHALQLCQQTGRDRPGDEDWVHRTSRLPPQEDTRAQRQRLQKQLTEHLRQSWGLLGAPIQARDLGELLQAWGAGAKTGAPKGSRFTHSEKFTFHLVGAPEDMRCVDGRGRLGGWLFVSAPHLYPHRFLCSHWTGPRPTVGWVPRGVPKLIRDLTGENVEGGNHAKVWGCSWGNTPFPQAVSFEHIFCPKMFTLRAPHPSHGHLRLERWGRWVGAVTGSGRFLHEQALWPEVADGAFTHIVTVWPPSVLQWACMPHWGQFSGEAEAGPREEGPSLAARMPLVTPLEEPQAQATQVSDVPATSRRPEQVTWAAQEQELESLREQLEGVNRSIEEVEADMKTLGVSFVQAESECRHSKLSTAEREQALRLKSRAVELLPDGTANLAKLQLVVENSAQRVIHLAGQWEKHRVPLLAEYRHLRKLQDCRELESSRRLAEIQELHQSVRAAAEEARRKEEVYKQLMSELETLPRDVSRLAYTQRILEIVGNIRKQKEEITKILSDTKELQKEINSLSGKLDRTFAVTDELVFKDAKKDDAVRKAYKYLAALHENCSQLIQTIEDTGTIMREVRDLEEQIETELGKKTLSNLEKIREDYRALRQENAGLLGRVREA

SEQ ID NO: 738425 - protein, 679 aa, Homo sapiens; identical to SEQ ID NO: 738423

SEQ ID NO: 738426 - protein, 273 aa, Homo sapiens
MKTLGVSFVQAESECRHSKLSTAEREQALRLKSRAVELLPDGTANLAKLQLVVENSAQRVIHLAGQWEKHRVPLLAEYRHLRKLQDCRELESSRRLAEIQELHQSVRAAAEEARRKEEVYKQLMSELETLPRDVSRLAYTQRILEIVGNIRKQKEEITKILSDTKELQKEINSLSGKLDRTFAVTDELVFKDAKKDDAVRKAYKYLAALHENCSQLIQTIEDTGTIMREVRDLEEQIETELGKKTLSNLEKIREDYRALRQENAGLLGRVREA

SEQ ID NO: 738427 - protein, 679 aa, Homo sapiens; identical to SEQ ID NO: 738423

SEQ ID NO: 738428 - protein, 531 aa, Homo sapiens
APCSLTELHFPTLPTRPVTLCGPRARSRVSTAAPHFLGPGPGPSPRLRHGSTMEEADRILIHSLRQAGTAVPPDVQTLRAFTTELVVEAVVRCLRVINPAVGSGLSPLLPLAMSARFRLAMSLAQACMDLGYPLELGYQNFLYPSEPDLRDLLLFLAERLPTDASEDADQPAGDSAILLRAIGSQIRDQLALPWVPPHLRTPKLQHLQGSALQKPFHASRLVVPELSSRGEPREFQASPLLLPVPTQVPQPVGRVASLLEHHALQLCQQTGRDRPGDEDWVHRTSRLPPQEDTRAQRQRLQKQLTEHLRQSWGLLGAPIQARDLGELLQAWGAGAKTGAPKGSRFTHSEKFTFHLEPQAQATQVSDVPATSRRPEQVTWAAQEQELESLREQLEGVNRSIEEVEADMKTLGVSFVQAESECRHSKLSTAEREQALRLKSRAVELLPDGTANLAKLQLVVENSAQRVIHLAGQWEKHRVPLLAEYRHLRKLQDCRELESSRRLAEIQELHQSVRAGGLGPRPLPTDRNPYMG

SEQ ID NO: 738429 - protein, 237 aa, Homo sapiens
LEGPACVTCTHPHQLVVENSAQRVIHLAGQWEKHRVPLLAEYRHLRKLQDCRELESSRRLAEIQELHQSVRAAAEEARRKEEVYKQLMSELETLPRDVSRLAYTQRILEIVGNIRKQKEEITKILSDTKELQKEINSLSGKLDRTFAVTDELVFKDAKKDDAVRKAYKYLAALHENCSQLIQTIEDTGTIMREVRDLEEQIETELGKKTLSNLEKIREDYRALRQENAGLLGRVREA

SEQ ID NO: 738430 - protein, 112 aa, Homo sapiens
RGCRVAALRLSPTHLGETDRRTRVARSTRNNEFLSRSWGTQARGCVQGRGWRGRDPRGSRDGLFKILYLRRSLALSPRLERNGAKSAHCSLDVQDSSDPPASASREGGGPRL

SEQ ID NO: 738431 - protein, 299 aa, Homo sapiens
RGCRVAALRLSPTHLGETDRRTRVARSTRNNEFLSRSWGTQARGCVQGRGWRGRDPRGSRDGLFKILYLRRSLALSPRLERNGAKSAHCSLDVQDSSDPPASASREGGPEGSSPGLTEGNTGLVRDLRPAHQDRSGTREDPAGQETTAITNPSPSLAADLAGDALPGCLGAAAHQGPLLDRSSESTLGPQALELEHCHERGCCRGCASFSPFPAPRCPSERLGAHSSRWAIRGRSKINPPPWAPACLPGFPVSWRTRMRAFHLSLPGGAQLLTYLVKVLKRRTWRRNVDNNPGCLCVPS

SEQ ID NO: 738432 - protein, 336 aa, Homo sapiens
RGCRVAALRLSPTHLGETDRRTRVARSTRNNEFLSRSWGTQARGCVQGRGWRGRDPRGSRDGLFKILYLRRSLALSPRLERNGAKSAHCSLDVQDSSDPPASASREAAQNREDSDKDTHLYKGGSFKRSHSCMGWDCRRTTVENPSPIRNCVNQEWPEGSSPGLTEGNTGLVRDLRPAHQDRSGTREDPAGQETTAITNPSPSLAADLAGDALPGCLGAAAHQGPLLDRSSESTLGPQALELEHCHERGCCRGCASFSPFPAPRCPSERLGAHSSRWAIRGRSKINPPPWAPACLPGGFPACLPAPKSSTDSASSCFKGGREFSDPLDIPGAGAMG

SEQ ID NO: 738433 - protein, 138 aa, Homo sapiens
RGCRVAALRLSPTHLGETDRRTRVARSTRNNEFLSRSWGTQARGCVQGRGWRGRDPRGSRDGLFKILYLRRSLALSPRLERNGAKSAHCSLDVQDSSDPPASASREGVARRLLSRPHRGKHWSSERPASCPSGPKRHA

SEQ ID NO: 738434 - protein, 138 aa, Homo sapiens
WTPGRSAGLVLLLALNAVGGRDWTSPETGGLLPLPATGGPSSQRGLLHDRLKSGNFMKSHPSTAPFPYCISSPAHSERIRPLSVSSGPFGVPHRQDKRGIAFSYRSGKSRHSGGNRDSQRASSHTCALPSSSKPNKAL

SEQ ID NO: 738435 - protein, 321 aa, Homo sapiens
AFPTQHPHSATAGEEGTRPGSQELRNMELIQDISRPPLEYVKGVPLIKYFAEALGPLQSFQARPDDLLISTYPKSGTTWVSQILDMIYQGGDLEKCHRAPIFMRVPFLEFKVPGIPSGMETLKNTPAPRLLKTHLPLALLPQTLLDQKVKVVYVARNAKDVAVSYYHFYHMAKVYPHPGTWESFLEKFMAGEVSYGSWYQHVQEWWELSRTHPVLYLFYEDMKENPKREIQKILEFVGRSLPEETVDLMVEHTSFKEMKKNPMTNYTTVRREFMDHSISPFMRKGMAGDWKTTFTVAQNERFDADYAEKMAGCSLSFRSEL

SEQ ID NO: 738436 - protein, 295 aa, Homo sapiens
MELIQDISRPPLEYVKGVPLIKYFAEALGPLQSFQARPDDLLISTYPKSGTTWVSQILDMIYQGGDLEKCHRAPIFMRVPFLEFKVPGIPSGMETLKNTPAPRLLKTHLPLALLPQTLLDQKVKVVYVARNAKDVAVSYYHFYHMAKVYPHPGTWESFLEKFMAGEVSYGSWYQHVQEWWELSRTHPVLYLFYEDMKENPKREIQKILEFVGRSLPEETVDLMVEHTSFKEMKKNPMTNYTTVRREFMDHSISPFMRKGMAGDWKTTFTVAQNERFDADYAEKMAGCSLSFRSEL

SEQ ID NO: 738437 - protein, 295 aa, Homo sapiens; identical to SEQ ID NO: 738436

SEQ ID NO: 738438 - protein, 323 aa, Homo sapiens
MELIQDISRPPLEYVKGVPLIKYFAEALGPLQSFQARPDDLLISTYPKSGTTWVSQILDMIYQGGDLEKCHRAPIFMRVPFLEFKVPGIPSGVCVLGARGVEEDRAGASAHQTFPDHCSGMETLKNTPAPRLLKTHLPLALLPQTLLDQKVKVVYVARNAKDVAVSYYHFYHMAKVYPHPGTWESFLEKFMAGEVSYGSWYQHVQEWWELSRTHPVLYLFYEDMKENPKREIQKILEFVGRSLPEETVDLMVEHTSFKEMKKNPMTNYTTVRREFMDHSISPFMRKGMAGDWKTTFTVAQNERFDADYAEKMAGCSLSFRSEL

SEQ ID NO: 738439 - protein, 221 aa, Homo sapiens
MELIQDISRPPLEYVKGVPLIKYFAEALGPLQSFQARPDDLLISTYPKSGTTWVSQILDMIYQGGDLEKCHRAPIFMRVPFLEFKVPGIPSGMETLKNTPAPRLLKTHLPLALLPQTLLDQKVKNPKREIQKILEFVGRSLPEETVDLMVEHTSFKEMKKNPMTNYTTVRREFMDHSISPFMRKGMAGDWKTTFTVAQNERFDADYAEKMAGCSLSFRSEL

SEQ ID NO: 738440 - protein, 99 aa, Homo sapiens
EVREVDPFYFPESAIQASTEEPSAAQNPKREIQKILEFVGRSLPEETVDLMVEHTSFKEMKKNPMTNYTTVRREFMDHSISPFMRKGRCRPARGFGAGG

SEQ ID NO: 738441 - protein, 108 aa, Homo sapiens
MQGWAQAGLSPFSQVPRRLLPQTTSQGQHQPSEPAVTALRNICLEAFFPDGEGQYSRTCKSTIPCISPSSRPPVGRPTDRGDEARDTAGGLWTAQPPAPTPRVGLQQP

SEQ ID NO: 738442 - protein, 1822 aa, Homo sapiens
AEGKSKDKGDMEVYIQPGPYVDPFTTVTLGWPDNDKELRFQWSCGSCWALWSSCVERQLLRTDQRELVVPASCLPPPDSAVTLRLAVLRGQELENRAEQCLYVSAPWELRPRVSCERNCRPVNASKDILLRVTMGEDSPVAMFSWYLDNTPTEQAEPLPDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQWEASLALQHASEALLTVSAKARPEDQRRQAATRDLFQAVGSVLEASLSNRPEEPAEASSSQIATVLRLLRVMEHVQTTLLLGKLPGGLPAMLATPSISVYTNRYKPAALQVPKKAHPLTWFIPHRHSKALCYGRAQETSLGAREVMGPRAGKGFPPREGPLVTMLSVCTAQEGRHGVPSPVLDPPEGVLRDGHMAAVQARGLNEWDSLLLTMLCMCLTSHCSLGLQGLKILLLLACARTHKHTHTQRAHLSVSTDAIPGMLHTFHSSTCQAGAGQCCWQHWDPLPQASVPPARVSLLDLTDSFPKQYPDSEERSEVGSPTRSERGKVKDQKRWGGVEDMTSEVQVGRGDNPGEKPASKLIYSFNENTDGLPVICQALLLDIGDTVVNQAGKAPPSWSLQSSCLLCCFCCNKHAEPPMGIKTHPHSDGEAGLPVVQEVWGLPRTLTFSSLPCHLCPHLVARIQPWSWQGSSLRPDAADSATFMLPAASSLSSLEGGQEPVDIKIMSFPKSPFPARSHFDVSGTVGGLRVTSPSGQLIPVKNLSENIEILLPRHSQRHSQPTVLNLTSPEALWVNVTSGEATLGIQLHWRPDIALTLSLGYGYHPNKSSYDAQTHLVPMVAPDELPTWILSPQDLRFGEGVYYLTVVPESDLEPAPGRDLTVGITTFLSHCVFWDEVQETWDDSGCQVGPRTSPYQTHCLCNHLTFFGSTFLVMSNAINIHQTAELFATFEDNPVVVTTVGCLCVVYVLVVIWARRKDAQDQAKVKVTVLEDNDPFAQYHYLVTVYTGHRRGAATSSKVTVTLYGLDGEREPHHLADPDTPVFERGAVDAFLLSTLFPLGELRSLRLWHDNSGDRPSWYVSRVLVYDLVMDRKWYFLCNSWLSINVGDCVLDKVFPVATEQDRKQFSHLFFMKTSAGFQDGHIWYSIFSRCARSSFTRVQRVSCCFSLLLCTMLTSIMFWGVPKDPAEQKMDLGKIEFTWQEVMIGLESSILMFPINLLIVQIFQNTRPRVAKEQNTGKWDRGSPNLTPSPQPMEDGLLTPEAVTKDVSRIVSSLFKALKVPSPALGWDSVNLMDINSLLALVEDVIYPQNTSGQVFWEEAKKREDPVTLTLGSSEMKEKSQCPKPKAARSGPWKDSAYRQCLYLQLEHVEQELRLVGPRGFSQPHSHAQALRQLQTLKGGLGVQPGTWAPAHASALQVSKPPQGLPWWCILVGWLLVAATSGVAAFFTMLYGLHYGRASSLRWLISMAVSFVESMFVTQPLKVLGFAAFFALVLKRVDDEEDTVAPLPGHLLGPDPYALFRARRNSSRDVYQPPLTAAIEKMKTTHLKEQKAFALIREILAYLGFLWMLLLVAYGQRDPSAYHLNRHLQHSFTRGFSGVLGFREFFKWANTTLVSNLYGHPPGKS

SEQ ID NO: 738443 - protein, 306 aa, Homo sapiens [sequence omitted]

SEQ ID NO: 738444 - protein, 1635 aa, Homo sapiens
MGEDSPVAMFSWYLDNTPTEQAEPLPDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQWEASLALQHASEALLTVSAKARPEDQRRQAATRDLFQAVGSVLEASLSNRPEEPAEASSSQIATVLRLLRVMEHVQTTLLLGKLPGGLPAMLATPSISVYTNRYKPAALQVPKKAHPLTWFIPHRHSKALCYGRAQETSLGAREVMGPRAGKGFPPREGPLVTMLSVCTAQEGRHGVPSPVLDPPEGVLRDGHMAAVQARGLNEWDYLLLTMLCMCLTSHCSLGLQGLKILLLLACARTHKHTHTQRAHLSVSTDAIPGMLHTFHSSTCQAGAGQCCWQHWDPLPQASVPPARVSLLDLTDSFPKQYPDSEERSEVGSPTRSERGKVKDQKRWGGVEDMTSEVQVGRGDNPGEKPASKLIYSFNENTDGLPVICQALLLDIGDTVVNQAGKAPPSWSLQSSCLLCCFCCNKHAEPPMGIKTHPHSDGEAGLPVVQEVWGLPRTLTFSSLPCHLCPHLVARIQPWSWQGSSLRPDAADSATFMLPAASSLSSLEGGQEPVDIKIMSFPKSPFPARSHFDVSGTVGGLRVTSPSGQLIPVKNLSENIEILLPRHSQRHSQPTVLNLTSPEALWVNVTSGEATLGIQLHWRPDIALTLSLGYGYHPNKSSYDAQTHLVPMVAPDELPTWILSPQDLRFGEGVYYLTVVPESDLEPAPGRDLTVGITTFLSHCVFWDEVQETWDDSGCQVGPRTSPYQTHCLCNHLTFFGSTFLVMSNAINIHQTAELFATFEDNPVVVTTVGCLCVVYVLVVIWARRKDAQDQAKVKVTVLEDNDPFAQYHYLVTVYTGHRRGAATSSKVTVTLYGLDGEREPHHLADPDTPVFERGAVDAFLLSTLFPLGELRSLRLWHDNSGDRPSWYVSRVLVYDLVMDRKWYFLCNSWLSINVGDCVLDKVFPVATEQDRKQFSHLFFMKTSAGFQDGHIWYSIFSRCARSSFTRVQRVSCCFSLLLCTMLTSIMFWGVPKDPAEQKMDLGKIEFTWQEVMIGLESSILMFPINLLIVQIFQNTRPRVAKEQNTGKWDRGSPNLTPSPQPMEDGLLTPEAVTKDVSRIVSSLFKALKVPSPALGWDSVNLMDINSLLALVEDVIYPQNTSGQVFWEEAKKREDPVTLTLGSSEMKEKSQCPKPKAARSGPWKDSAYRQCLYLQLEHVEQELRLVGPRGFSQPHSHAYGPQAAADPEGRPGGTAGHLGPCTCQVLGFAAFFALVLKRVDDEEDTVAPLPGHLLGPDPYALFRARRNSSRDVYQPPLTAAIEKMKTTHLKEQKAFALIREILAYLGFLWMLLLVAYGQRDPSAYHLNRHLQHSFTRGFSGVLGFREFFKWANTTLVSNLYGHPPAAAGISQRMPCTIFPGC

SEQ ID NO: 738445 - protein, 1664 aa, Homo sapiens
AALSPPGMQSCERNCRPVNASKDILLRVTMGEDSPVAMFSWYLDNTPTEQAEPLPDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQWEASLALQHASEALLTVSAKARPEDQRRQAATRDLFQAVGSVLEASLSNRPEEPAEASSSQIATVLRLLRVMEHVQTTLLLGKLPGGLPAMLATPSISVYTNRYKPAALQVPKKAHPLTWFIPHRHSKALCYGRAQETSLGAREVMGPRAGKGFPPREGPLVTMLSVCTAQEGRHGVPSPVLDPPEGVLRDGHMAAVQARGLNEWDSLLLTMLCMCLTSHCSLGLQGLKILLLLACARTHKHTHTQRAHLSVSTDAIPGMLHTFHSSTCQAGAGQCCWQHWDPLPQASVPPARVSLLDLTDSFPKQYPDSEERSEVGSPTRSERGKVKDQKRWGGVEDMTSEVQVGRGDNPGEKPASKLIYSFNENTDGLPVICQALLLDIGDTVVNQAGKAPPSWSLQSSCLLCCFCCNKHAEPPMGIKTHPHSDGEAGLPVVQEVWGLPRTLTFSSLPCHLCPHLVARIQPWSWQGSSLRPDAADSATFMLPAASSLSSLEGGQEPVDIKIMSFPKSPFPARSHFDVSGTVGGLRVTSPSGQLIPVKNLSENIEILLPRHSQRHSQPTVLNLTSPEALWVNVTSGEATLGIQLHWRPDIALTLSLGYGYHPNKSSYDAQTHLVPMVAPDELPTWILSPQDLRFGEGVYYLTVVPESDLEPAPGRDLTVGITTFLSHCVFWDEVQETWDDSGCQVGPRTSPYQTHCLCNHLTFFGSTFLVMSNAINIHQTAELFATFEDNPVVVTTVGCLCVVYVLVVIWARRKDAQDQAKVKVTVLEDNDPFAQYHYLVTVYTGHRRGAATSSKVTVTLYGLDGEREPHHLADPDTPVFERGAVDAFLLSTLFPLGELRSLRLWHDNSGDRPSWYVSRVLVYDLVMDRKWYFLCNSWLSINVGDCVLDKVFPVATEQDRKQFSHLFFMKTSAGFQDGHIWYSIFSRCARSSFTRVQRVSCCFSLLLCTMLTSIMFWGVPKDPAEQKMDLGKIEFTWQEVMIGLESSILMFPINLLIVQIFQNTRPRVAKEQNTGKWDRGSPNLTPSPQPMEDGLLTPEAVTKDVSRIVSSLFKALKVPSPALGWDSVNLMDINSLLALVEDVIYPQNTSGQVFWEEAKKREDPVTLTLGSSEMKEKSQCPKPKAARSGPWKDSAYRQCLYLQLEHVEQELRLVGPRGFSQPHSHAYGPQAAADPEGRPGGTAGHLGPCTCQVLGFAAFFALVLKRVDDEEDTVAPLPGHLLGPDPYALFRARRNSSRDVYQPPLTAAIEKMKTTHLKEQKAFALIREILAYLGFLWMLLLVAYGQRDPSAYHLNRHLQHSFTRGFSGVLGFREFFKWANTTLVSNLYGHPPAAAGISQRMPCTIFPGC

SEQ ID NO: 738446 - protein, 333 aa, Homo sapiens
MRRLAGRAGHSQVTQDSKFSPKTPSDAERHKGLPRDWLQSLLLSLRGPPAPHCLLLFLREARGRDQPGSGQRDRRGGLPEGRVGAPDLRALQDSPPQAQVEPPQGPPGQEGREPTSFFSSQPRPSPRRGSRGEGEEEEGGGERELVLSLSSALRAEVRHRDMKLEDKFPSRASSGSPSRRKFDTWISRTTNNKKARQRQQLAVSRGAGLRRPGEQRRPRRKYEDSTWRLRAGALLLSPQHLSSQSPAGAPTGSQRGMAATDFVQEMRAVGERLLLKLQRLPQAEPVEIVAFSVIILFTATVLLLLLIACSCCCTHCCCPERRGRKVQVQPTPP

SEQ ID NO: 738447 - protein, 333 aa, Homo sapiens; identical to SEQ ID NO: 738446

SEQ ID NO: 738448 - protein, 34 aa, Homo sapiens
MTLESEREGEAPLDISCGVSSARPIVAARSGVPK

SEQ ID NO: 738449 - protein, 104 aa, Homo sapiens
GCRNRPVKERPPGLQCLLHPRSAVATMGSGLPLVLLLTLLGSSHGTGPGMTLQLKLKESFLTNSSYESSFLELLEKLCLLLHLPSGTSVTLHHARSQHHVVCNT

SEQ ID NO: 738450 - protein, 104 aa, Homo sapiens; identical to SEQ ID NO: 738449

SEQ ID NO: 738451 - protein, 535 aa, Homo sapiens
MGSSATEIEELENTTFKYLTGEQTEKMWQRLKGILRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 738452 - protein, 212 aa, Homo sapiens
MGKKINKLFCFNFLVQCFRGKSKPSKCQIRKKVKNHIERLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMVRQSL

SEQ ID NO: 738453 - protein, 247 aa, Homo sapiens
MTLKERLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTR

SEQ ID NO: 738454 - protein, 519 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 738455 - protein, 519 aa, Homo sapiens; identical to SEQ ID NO: 738454

SEQ ID NO: 738456 - protein, 529 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 738457 - protein, 535 aa, Homo sapiens; identical to SEQ ID NO: 738451

SEQ ID NO: 738458 - protein, 501 aa, Homo sapiens
MGKKINKLFCFNFLVQCFRGKSKPSKCQIRKKVKNHIERLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 738459 - protein, 535 aa, Homo sapiens; identical to SEQ ID NO: 738451

SEQ ID NO: 738460 - protein, 535 aa, Homo sapiens; identical to SEQ ID NO: 738451

SEQ ID NO: 738461 - protein, 535 aa, Homo sapiens; identical to SEQ ID NO: 738451

SEQ ID NO: 738462 - protein, 537 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEGSVVYEALLPSLSVFTSPLRVWITSSRFLLL

SEQ ID NO: 738463 - protein, 537 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGQSWRGRWRSGSNFRQEGHRFLLFLPECPTIF

SEQ ID NO: 738464 - protein, 537 aa, Homo sapiens; identical to SEQ ID NO: 738463

SEQ ID NO: 738465 - protein, 508 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGYR

SEQ ID NO: 738466 - protein, 268 aa, Homo sapiens
GILFLILRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 738467 - protein, 71 aa, Homo sapiens
APLIPPQGGCRLWIREREHLGKLDLWGVCCFARFERGRKGIPLTLNSGRSGCDPGSWVECTGLSRAQLVIA

SEQ ID NO: 738468 - protein, 173 aa, Homo sapiens [sequence omitted]

SEQ ID NO: 738469 - protein, 858 aa, Homo sapiens
RRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 738470 - protein, 858 aa, Homo sapiens; identical to SEQ ID NO: 738469

SEQ ID NO: 738471 - protein, 858 aa, Homo sapiens; identical to SEQ ID NO: 738469

SEQ ID NO: 738472 - protein, 853 aa, Homo sapiens
MALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNDFPEAMQDDPVARLPCASLWSCAELQGASPLTGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 738473 - protein, 307 aa, Homo sapiens
MEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 738474 - protein, 853 aa, Homo sapiens; identical to SEQ ID NO: 738472

SEQ ID NO: 738475 - protein, 113 aa, Homo sapiens
NSIRSLDALHNITPGRDCLWSLEVQAKDRGSPSFSTTALLKIDITDAEVSTKPWSGKRGQQASSDLSATWAEREGPSPGFLQKTLNVIKGSLCHQTHSLWKRVEFLVQYLLMV

SEQ ID NO: 738476 - protein, 362 aa, Homo sapiens
MSGMWEDQSIEDWYKNQGRILRNHMEEGLSESKEYDKCGKAFSQKENFLSHQKHHTGEKPYECEKVSIQMPTIIRHQKNHTGTKPYACKECGKAFNGKAYLTEHEKIHTGEKPFECNQCGRAFSQKQYLIKHQNIHTGKKPFKCSECGKAFSQKENLIIHQRIHTGEKPYECKGCGKAFIQKSSLIRHQRSHTGEKPYTCKECGKAFSGKSNLTEHEKIHIGEKPYKCNECGTIFRQKQYLIKHHNIHTGEKPYECNKCGKAFSRITSLIVHVGIHTGDKPYECKVCGKAFCQSSSLTVHMRSHTGEKPYGCNECGKAFSQFSTLALHMRIHTGEKPYQCSECGKAFSQKSHHIRHQRIHTH

SEQ ID NO: 738477 - protein, 66 aa, Homo sapiens
GVRRRGISDLPWSSLSAGLLPCISTGAAKPLRVLRALPEFWDAALFPNHNIQVQCHFSAHKFKVST

SEQ ID NO: 738478 - protein, 66 aa, Homo sapiens; identical to SEQ ID NO: 738477

SEQ ID NO: 738479 - protein, 409 aa, Homo sapiens
MLESLQHESDLLQHDQIHTGEKPYECNECRKTFSLKQNLVEHKKMHTGEKSHECTECGKVCSRVSSLTLHLRSHTGKKAYKCNKCGKAFSQKENFLSHQKHHTGEKPYECEKVSIQMPTIIRHQKNHTGTKPYACKECGKAFNGKAYLTEHEKIHTGEKPFECNQCGRAFSQKQYLIKHQNIHTGKKPFKCSECGKAFSQKENLIIHQRIHTGEKPYECKGCGKAFIQKSSLIRHQRSHTGEKPYTCKECGKAFSGKSNLTEHEKIHIGEKPYKCNECGTIFRQKQYLIKHHNIHTGEKPYECNKCGKAFSRITSLIVHVGIHTGDKPYECKVCGKAFCQSSSLTVHMRSHTGEKPYGCNECGKAFSQFSTLALHMRIHTGEKPYQCSECGKAFSQKSHHIRHQRIHTH

SEQ ID NO: 738480 - protein, 409 aa, Homo sapiens; identical to SEQ ID NO: 738479

SEQ ID NO: 738481 - protein, 113 aa, Homo sapiens
MCICRNAPLHLCDTPAHLHTPICIQAQTHSHTFAHTATNLHKQHLYTDTYPFVPIQCTLTHLHTAVLAHTFAHTHLHTCTHTTHLSVQHTYLCAYMHICTCTQQWHTLLYHSP

SEQ ID NO: 738482 - protein, 114 aa, Homo sapiens
VSGPCLQDDKEKKEQWSCQKGPRHVQPIRCTNCARCVPKDKAIKKFVIRNIVEAAAVRDISEASVFDAYVLPKLYVKLHYCVSGAIHSKVVRNRSREFVNIWILIQTSLLTSLW

SEQ ID NO: 738483 - protein, 150 aa, Homo sapiens
MRRGWKMALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAM

SEQ ID NO: 738484 - protein, 119 aa, Homo sapiens
TDHPSAPTWLVLNAVTQACCARQGALSSAAPQVAKAPREGSRQLDSGVPHSAPSSLAAATLAVPTRRQQACLVDLRAKDAARLEDGSVWGAAVLPPGTVLGASARYCPRRALVLLCLRL

SEQ ID NO: 738485 - protein, 152 aa, Homo sapiens
MRRGWKMALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGGQFIQRQLERQLSKYLRKAKSYMFSN

SEQ ID NO: 738486 - protein, 67 aa, Homo sapiens
AEQGAEVFPGGADLWPRVAAQPRVALAAVRHLVLPSLTSPFPSLDAGFLPKSSEPPGVFCLFGNNSS

SEQ ID NO: 738487 - protein, 350 aa, Homo sapiens
MEVPNVKDFQWKRLAPLPSRRVYCSLLETGGQVYAIGGCDDNGVPMDCFEVYSPEADQWTALPRLPTARAGVAVTALGKRIMVIGGVGTNQLPLKVVEMYNIDEGKWKKRSMLREAAMGISVTAKDYRVYAAGGMGLDLRPHNHLQHYDMLKDMWVSLAPMPTPRYAATSFLRGSKIYVLGGRQSKYAVNAFEVFDIETRSWTKFPNIPYKRAFSSFVTLDNHLYSLGGLRQGRLYRQPKFLRTMDVFDMEQGGWLKMERSFFLKKRRADFVAGSLSGRVIVAGGLGNQPTVLETAEAFHPGKNKWEILPAMPTPRCACSSIVVKNCLLAVGGVNQGLSDAVEALCVSDS

SEQ ID NO: 738488 - protein, 242 aa, Homo sapiens
SCCTCELSQGHVWPFFLDYRVYAAGGMGLDLRPHNHLQHYDMLKDMWVSLAPMPTPRYAATSFLRGSKIYVLGGRQSKYAVNAFEVFDIETRSWTKFPNIPYKRAFSSFVTLDNHLYSLGGLRQGRLYRQPKFLRTMDVFDMEQGGWLKMERSFFLKKRRADFVAGSLSGRVIVAGGLGNQPTVLETAEAFHPGKNKWEILPAMPTPRCACSSIVVKNCLLAVGGVNQGLSDAVEALCVSDS

SEQ ID NO: 738489 - protein, 350 aa, Homo sapiens; identical to SEQ ID NO: 738487

SEQ ID NO: 738490 - protein, 350 aa, Homo sapiens; identical to SEQ ID NO: 738487

SEQ ID NO: 738491 - protein, 354 aa, Homo sapiens
DYENPSNLAAGNKYTVIIQVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDGQLDVLTGKKAEALVETGTVTLSIKVIPHPTTIITTTPRPRVTYQVLRKNVYSPSAWYVPFVITLGSILLLGLLVYLVVLLAKAIHRHCPCKTGKNKEPLKLPVETKTAERDVVVETIQMNTIFDGEAIDPVTGETYEFNSKTGARKWKDPLTQMPKWKESSHQGAAPRRVTAGEGMGSLRSANWEEDELSGKAWAEDAGLGSRNEGGKLGNPKNRNPAFMNRAYPKPHPGK

SEQ ID NO: 738492 - protein, 375 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQQLEEKYRQEDQRERELRTLLLQQSNV

SEQ ID NO: 738493 - protein, 375 aa, Homo sapiens; identical to SEQ ID NO: 738492

SEQ ID NO: 738494 - protein, 375 aa, Homo sapiens; identical to SEQ ID NO: 738492

SEQ ID NO: 738495 - protein, 375 aa, Homo sapiens; identical to SEQ ID NO: 738492

SEQ ID NO: 738496 - protein, 375 aa, Homo sapiens; identical to SEQ ID NO: 738492

SEQ ID NO: 738497 - protein, 375 aa, Homo sapiens; identical to SEQ ID NO: 738492

SEQ ID NO: 738498 - protein, 127 aa, Homo sapiens
MSKGEFSFHSNKDRFAHSLKQNVAMNIQPLHTYKDVRMIPPTKHTHSHTRTHTHMHTRACTHAHMHTHIRTRKHMHTCTHVHTCTHAHTCTGPGSSSIIMVVISERHLRLRQQVLDKYVHVYLVLVL

SEQ ID NO: 738499 - protein, 236 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLQWNPRFAGITLRVRLAGCKR

SEQ ID NO: 738500 - protein, 474 aa, Homo sapiens
MGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWITSMEAASGEGSAAGDLDAATGDRGPQATLSQTPAVGPWGPPGKESSVKRATCPGLSTLKEIKVSAVLTQNPHSLLCVSAAQEAERVTLIQMTHFLEVNPQADQLPHVERKMLQDDSLPAGASLTAPERNPGP

SEQ ID NO: 738501 - protein, 558 aa, Homo sapiens
MDGEATVKPGEQRSGEERKRSGLLHAHCGTLPQSHVTSRRAGWKMPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWITSMEAASGEGSAAGDLDAATGDRGPQATLSQTPAVGPWGPPGKESSVKRATCPGLSTLKEIKVSAVLTQNPHSLLCVSAAQEAERVTLIQMTHFLEVNPQADQLPHVERKMLQDDSLPAGASLTAPERNPGP

SEQ ID NO: 738502 - protein, 394 aa, Homo sapiens
MDGEATVKPGEQRSGEERKRSGLLHAHCGTLPQSHVTSRRAGWKMPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQQH

SEQ ID NO: 738503 - protein, 263 aa, Homo sapiens
MALVPGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGLWEYSHLLPPNSFEGAEEEAVQTPAGVESGAASEAPGGRGCDRPRADHAAPPQEAGVQCTCQHYTVREEAQKTPPADPACPEREDSHGSGSPFKASQD

SEQ ID NO: 738504 - protein, 138 aa, Homo sapiens
AGVEVRTVNWSGIATMGAPGGKINRPRTELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 738505 - protein, 138 aa, Homo sapiens; identical to SEQ ID NO: 738504

SEQ ID NO: 738506 - protein, 191 aa, Homo sapiens
SGSGSTDRELEWNRDYGSSGGKDQPAPNGDCVGAATLFPQAFLSPFISHEMGSVRGRGCLVEEAPGRGEPTPSDSHLSPRQELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 738507 - protein, 191 aa, Homo sapiens; identical to SEQ ID NO: 738506

SEQ ID NO: 738508 - protein, 132 aa, Homo sapiens
MSALVGNIRPGPNCAVVYRMNGVQYAVVVVEYCESCQSERDRLRSGSSNTTTELIRRNHLIKVSPDVTDAIHLLMCRRYINAPRKTSIQTEFGLVPMQHTKPCLRSVNDVTMLHSKFLPGTVVITSGIKRMC

SEQ ID NO: 738509 - protein, 254 aa, Homo sapiens
MALVPGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGLWEYSHLLPPNSFEGAEEEAVQTPAGVESGAASEAPGGRGCDRPRADHAAPPQEAGVQCTCQHYTVREEAQKTPPADPACPEREDSHGR

SEQ ID NO: 738510 - protein, 254 aa, Homo sapiens; identical to SEQ ID NO: 738509

SEQ ID NO: 738511 - protein, 371 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVVGCSPAAEETAAWVLPFTSGGFLYIALVNVLPDLLEEEDPWRSLQQLLLLCAGIVVMVLFSLFVD

SEQ ID NO: 738512 - protein, 364 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVEETAAWVLPFTSGGFLYIALVNVLPDLLEEEDPWRSLQQLLLLCAGIVVMVLFSLFVD

SEQ ID NO: 738513 - protein, 340 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVEETAAWVLPFTSGGFLYIALVNVLPDLLEEEDPW

SEQ ID NO: 738514 - protein, 405 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKWPTQCPPRASSEQSKPLWNEWAMWGAQPSTQTPQPRLPSLQIGLLTTMAILLHEIPHEVGDFAILLRAGFDRWSAAKLQLSTALGGLLGAGFAICTQSPKGVEETAAWVLPFTSGGFLYIALVNVLPDLLEEEDPWRSLQQLLLLCAGIVVMVLFSLFVD

SEQ ID NO: 738515 - protein, 414 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVGTGVAGGCGGWHQQRGTSQRVWLPHCWSPGPGGGEHTQCLGYPVGCSPAAEETAAWVLPFTSGGFLYIALVNVLPDLLEEEDPWRSLQQLLLLCAGIVVMVLFSLFVD

SEQ ID NO: 738516 - protein, 328 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQVSGYLNLLANTIDNFTHGLAVAASFLVSKKIGLLTTMAILLHEIPHEVGDFAILLRAGFDRWSAAKLQLSTALGGLLGAGFAICTQSPKGVEETAAWVLPFTSGGFLYIALVNVLPDLLEEEDPWRSLQQLLLLCAGIVVMVLFSLFVD

SEQ ID NO: 738517 - protein, 364 aa, Homo sapiens; identical to SEQ ID NO: 738512

SEQ ID NO: 738518 - protein, 328 aa, Homo sapiens; identical to SEQ ID NO: 738516

SEQ ID NO: 738519 - protein, 377 aa, Homo sapiens
MRPDRCRAAHVRGMPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVEETAAWVLPFTSGGFLYIALVNVLPDLLEEEDPWRSLQQLLLLCAGIVVMVLFSLFVD

SEQ ID NO: 738520 - protein, 364 aa, Homo sapiens; identical to SEQ ID NO: 738512

SEQ ID NO: 738521 - protein, 364 aa, Homo sapiens; identical to SEQ ID NO: 738512

SEQ ID NO: 738522 - protein, 364 aa, Homo sapiens; identical to SEQ ID NO: 738512

SEQ ID NO: 738523 - protein, 364 aa, Homo sapiens; identical to SEQ ID NO: 738512

SEQ ID NO: 738524 - protein, 364 aa, Homo sapiens; identical to SEQ ID NO: 738512

SEQ ID NO: 738525 - protein, 292 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKVRGLGPVGLWRFQWQPCGFHLCLESLLLAPPLPAPSSKALIPHPPCC

SEQ ID NO: 738526 - protein, 78 aa, Homo sapiens
RISTSVRLGSRSLYPVPQGVEETAAWVLPFTSGGFLYIALVNVLPDLLEEEDPWRSLQQLLLLCAGIVVMVLFSLFVD

SEQ ID NO: 738527 - protein, 231 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKRQRYLNLLPDDDTTWA

SEQ ID NO: 738528 - protein, 238 aa, Homo sapiens
MPGCPCPGCGMAGPRLLFLTALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGNEATRQGQDSARSGGLVPTPRDGQDDQERDSGFLAGACLGGREGHCPGLWALVPVGVLGPSCPTHPCHCPGALDEIPFQMAPSYGPGLAWPGLAWHCRP

SEQ ID NO: 738529 - protein, 320 aa, Homo sapiens
FNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 738530 - protein, 144 aa, Homo sapiens
AYYYYKIRGRVDIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 738531 - protein, 304 aa, Homo sapiens
FNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTERAERNKIRN

SEQ ID NO: 738532 - protein, 87 aa, Homo sapiens
DSPTLSLVVVGGFTGDAIAVSGLLAHFQVQSMLLTLAVPSGDWLCGAAPQLAPAEFGVWMAAGRADECDFVSFPPAAICLGLYFRCL

SEQ ID NO: 738533 - protein, 104 aa, Homo sapiens
YTRSGIAGSYGNSLIFLGELLSHFPQQLHHFMFPPTVYNNFNFSTSLFLLIVATLMCMRCHLVVWCGLCFNQMLGPLSVLHLGRVRNHLRSVCCLPILKFLVCT

SEQ ID NO: 738534 - protein, 494 aa, Homo sapiens
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 738535 - protein, 396 aa, Homo sapiens
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNHHRTRLQSCK

SEQ ID NO: 738536 - protein, 472 aa, Homo sapiens
KFNSILLIHTKKVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 738537 - protein, 304 aa, Homo sapiens
MSSIKHLVYAVIRFLREQSQMDTYTSDEQESLEVAIQCLETVFKISPEDTHLAVSQPLTEMFTSSFCKNDVLPLSNSVPEDVGKADQLKDEGNNHMKEENYAAAVDCYTQAIELDPNNAVYYCNRAAAQSKLGHYTDAIKDCEKAIAIDSKYSKAYGRMGLALTALNKFEEAVTSYQKALDLDPENDSYKSNLKIAEQKLREVSSPTGTGLSFDMASLINNPAFISMAASLMQNPQVQQLMSGMMTNAIGGPAAGVGGLTDLSSLIQAGQQFAQQIQQQNPELIEQLRNHIRSRSFSSSAEEHS

SEQ ID NO: 738538 - protein, 82 aa, Homo sapiens
VFQFQAASLMQNPQVQQLMSGMMTNAIGGPAAGVGGLTDLSSLIQAGQQFAQQIQQQNPELIEQLRNHIRSRSFSSSAEEHS

SEQ ID NO: 738539 - protein, 236 aa, Homo sapiens
TRGSTHASAVPEDVGKADQLKDEGNNHMKEENYAAAVDCYTQAIELDPNNAVYYCNRAAAQSKLGHYTDAIKDCEKAIAIDSKYSKAYGRMGLALTALNKFEEAVTSYQKALDLDPENDSYKSNLKIAEQKLREVSSPTGTGLSFDMASLINNPAFISMAASLMQNPQVQQLMSGMMTNAIGGPAAGVGGLTDLSSLIQAGQQFAQQIQQQNPELIEQLRNHIRSRSFSSSAEEHS

SEQ ID NO: 738540 - protein, 230 aa, Homo sapiens [sequence omitted]

SEQ ID NO: 738541 - protein, 82 aa, Homo sapiens; identical to SEQ ID NO: 738538

SEQ ID NO: 738542 - protein, 133 aa, Homo sapiens
ARTVSQDPVQLDVKYTRDRERLLGHCLWSAGGRLGWELLSWGHLGSRSLMADSRVTLPGQPPFNPGLPPGGVVTWLSVFRPQKNSHDVRIGCSQIWGVPRSQEVQQNWWGAGTFSSTSHSLFLLITPTKIFSL

SEQ ID NO: 738543 - protein, 301 aa, Homo sapiens
EKEKIPFILEGSLKAWKEEQHRLAEEERLREEKKAEKKGKEAGKKKGKDNAEKEDSRSLKKKSPYKEKSKEEQVKIQEVTEESPHQPEPKITYPFHGYNMGNIPTQISGSNYYLYPSDGGQIEVEKTMFEKGPTFIKVRVVKDNHNFMIHLNDPKEIVKKEEKGDYYLEEEEEGDEEQSLETEVSDAKNKAFSKFGSFSATLENGICLSISYYGSNGMAPEDKDPDLETILNIPSALTPTVVPVIVTVPQSKAKGKIKGKEKPKESLKEEEHPKEEEKKVNEPCHRFPNSVSASVLTFLKP

SEQ ID NO: 738544 - protein, 299 aa, Homo sapiens
EKEKIPFILEGSLKAWKEEQHRLAEEERLREEKKAEKKGKEAGKKKGKDNAEKEDSRSLKKKSPYKEKSKEEQVKIQEVTEESPHQPEPKITYPFHGYNMGNIPTQISGSNYYLYPSDGGQIEVEKTMFEKGPTFIKVRVVKDNHNFMIHLNDPKEIVKKEEKGDYYLEEEEEGDEEQSLETEVSDAKNKAFSKFGSFSATLENGICLSISYYGSNGMAPEDKDPDLETILNIPSALTPTVVPVIVTVPQSKAKGKIKGKEKPKESLKEEEHPKEEEKKEEEVEPEPVLQETLDVPTFQ

SEQ ID NO: 738545 - protein, 73 aa, Homo sapiens
RVLAVVFFPGILLCVGFVGFFHKHILCLVFKTYTCSTAIYSPFIPTLFNVTPHTCISPCTDPLLAPACKSALF

SEQ ID NO: 738546 - protein, 120 aa, Homo sapiens [sequence omitted]

SEQ ID NO: 738547 - protein, 1023 aa, Homo sapiens
MWDQRLVKLALLQHLRAFYGIKVKGVRGQCDRRRHETAATEIGGKIFGVPFNALPHSAVPEYGHIPSFLVDACTSLEEHIHTEGLFRKSGSVIRLKALKNKVDHGEGCLSSAPPCDIAGLLKQFFRELPEPILPADLHEALLKAQQLGTEEKNKAILLLSCLLADHTVHVLRYFFNFLRNVSLRSSENKMDSSNLAVIFAPNLLQTSEGHEKMSSNAEKKVRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTSKPVDL

SEQ ID NO: 738548 - protein, 772 aa, Homo sapiens [sequence omitted]

SEQ ID NO: 738549 - protein, 241 aa, Homo sapiens
MWDQRLVKLALLQHLRAFYGIKVKGVRGQCDRRRHETAATEIGGKIFGVPFNALPHSAVPEYGHIPSFLVDACTSLEEHIHTEGLFRKSGSVIRLKALKNKVDHGEGCLSSAPPCDIAGLLKQFFRELPEPILPADLHEALLKAQQLGTEEKNKAILLLSCLLADHTVHVLRYFFNFLRNVSLRSSENKMDSSNLAVIFAPNLLQTSEGHEKMSSNAEKKVRLQAAVVQTLIDYASDIGKM

SEQ ID NO: 738550 - protein, 772 aa, Homo sapiens [sequence omitted]

SEQ ID NO: 738551 - protein, 772 aa, Homo sapiens [sequence omitted]

SEQ ID NO: 738552 - protein, 1007 aa, Homo sapiens
SDSRARKRTGISCLLHFLKYCEWSEAQGKIFGVPFNALPHSAVPEYGHIPSFLVDACTSLEEHIHTEGLFRKSGSVIRLKALKNKVDHGEGCLSSAPPCDIAGLLKQFFRELPEPILPADLHEALLKAQQLGTEEKNKAILLLSCLLADHTVHVLRYFFNFLRNVSLRSSENKMDSSNLAVIFAPNLLQTSEGHEKMSSNAEKKVRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTSKPVDL

SEQ ID NO: 738553 - protein, 123 aa, Homo sapiens
RSTGALPCGFERLLAHRVSGIQPCFLPPPFLAVPDASPEIYHIKEVHCQIQQETQVIGNNLAAEALVSLRNMRALVLGLQTAPEAPFLSEVLLTWPGRVAHGYSPSYWEAMVGGSFEARSLRL

SEQ ID NO: 738554 - protein, 76 aa, Homo sapiens
RACAPPAARRPPRLGVRRFHLVMVSVRLSNGGYGYVEDSWGCRTPRGYCRAPGGRGRRWGGGGLPRPQKPHSQKRF

SEQ ID NO: 738555 - protein, 68 aa, Homo sapiens
TAQRVQRTPLAKADLPGLGGGERKTEVETTCPAENYPQAYSNHFSVELIPSVHTKGANPSCIPPTDTG

SEQ ID NO: 738556 - protein, 264 aa, Homo sapiens [sequence omitted]

SEQ ID NO: 738557 - protein, 309 aa, Homo sapiens
MAVGKNKRLTKGGKKGAKKKVVDPFSKKDWYDVKAPAMFNIRNIGKTLVTRTQGTKIASDGLKGSLLFDTLSSLACTLRRTPDVTRSATFSRTDIFTRLDSTLTRLVSTRPTETLWPWNLSLSPLRQWALVYPAARTHWCSHSAHPHTTHWADATDLALCTGLHDLQCSQNLTGLRSPCFVCSVLVLLKNATIRYGRPLMLSTNRSAKSGKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 738558 - protein, 117 aa, Homo sapiens
MNQEDRQTHTHTHTPHQDESALYSPHLKPVVSVTTAEGLSSVLVLLNPIPVVAEAASSAQSPTEGFLSPFGIRSGFTTHSLHVPLFLSLAHFPSVYWRQDWQEHRHSAEHAPARPQC

SEQ ID NO: 738559 - protein, 111 aa, Homo sapiens
NSPVSASRVAGITGVCHHAQLIFVFFVKTGLRHVGQAGLKFLTLGDPPALASQSAGITGISHHARPYHKFAIENYIHVRHLSAFFVCFNVNKSLGILINILAILEIFDTFM

SEQ ID NO: 738560 - protein, 191 aa, Homo sapiens
MSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKTGFWREDYHDHS

SEQ ID NO: 738561 - protein, 191 aa, Homo sapiens; identical to SEQ ID NO: 738560

SEQ ID NO: 738562 - protein, 191 aa, Homo sapiens; identical to SEQ ID NO: 738560

SEQ ID NO: 738563 - protein, 177 aa, Homo sapiens
MSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDLYRLTFQTNWKDLTINHQFLHLKGAYLASRYLFQAHTVLTQFPSTNLNLAHCHKP

SEQ ID NO: 738564 - protein, 124 aa, Homo sapiens
MSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDQA

SEQ ID NO: 738565 - protein, 191 aa, Homo sapiens; identical to SEQ ID NO: 738560

SEQ ID NO: 738566 - protein, 191 aa, Homo sapiens; identical to SEQ ID NO: 738560

SEQ ID NO: 738567 - protein, 191 aa, Homo sapiens; identical to SEQ ID NO: 738560

SEQ ID NO: 738568 - protein, 191 aa, Homo sapiens; identical to SEQ ID NO: 738560

SEQ ID NO: 738569 - protein, 191 aa, Homo sapiens; identical to SEQ ID NO: 738560

SEQ ID NO: 738570 - protein, 191 aa, Homo sapiens; identical to SEQ ID NO: 738560

SEQ ID NO: 738571 - protein, 191 aa, Homo sapiens; identical to SEQ ID NO: 738560

SEQ ID NO: 738572 - protein, 203 aa, Homo sapiens
LQEFGTLKNPAKMSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKTGFWREDYHDHS

SEQ ID NO: 738573 - protein, 212 aa, Homo sapiens
MIKLWTNRDLHIIVMVKNPAKMSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKTGFWREDYHDHS

SEQ ID NO: 738574 - protein, 135 aa, Homo sapiens
MGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKTGFWREDYHDHS

SEQ ID NO: 738575 - protein, 167 aa, Homo sapiens
GRVGRPTRSRSFCPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKTGFWREDYHDHS

SEQ ID NO: 738576 - protein, 191 aa, Homo sapiens; identical to SEQ ID NO: 738560

SEQ ID NO: 738577 - protein, 173 aa, Homo sapiens
MSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGFWREDYHDHS

SEQ ID NO: 738578 - protein, 191 aa, Homo sapiens; identical to SEQ ID NO: 738560

SEQ ID NO: 738579 - protein, 158 aa, Homo sapiens
MIKLWTNRDLHIIVMVKNPAKMSLYPSLEDLKVDKVIQAQTAFSANPANPAILSEASAPIPHDGNLYPRLYPELSQYMGLSLNEEEIRANVAVVSGAPLQGGIFVQLVQANSPASLVGLRFGDQVLQINGENCAGWSSDKAHKVLKTGFWREDYHDHS

SEQ ID NO: 738580 - protein, 93 aa, Homo sapiens
MSLYPSLEDLKVDKVIQAQTAFSANPANPAILSEASAPIPHDGNLYPRLYPELSQYMGLSLNEEEIRANVAVVSGAPLQGLGSKTSDDNVLLT

SEQ ID NO: 738581 - protein, 254 aa, Homo sapiens
LGHFRRVRLASARCTMAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738582 - protein, 253 aa, Homo sapiens
APGWYGPELWDRCTMAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738583 - protein, 102 aa, Homo sapiens
APGWYGPELWDRCTMAALKSWLSRSVTSFFRYRCGRVEGTGPEGGTDADSAVARPTAPAFLTRSSLVRPAGSRRLAPVGRTEDSPASAPWVKPGFLFSSSIF

SEQ ID NO: 738584 - protein, 312 aa, Homo sapiens
APGWYGPELWDRCTMAALKSWLSRSVTSFFRYRCGRVEGTGPEGGTDADSAVARPTAPPSLRAHLSSAQLGRGVSLRSGGLRTAPPPPPGYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738585 - protein, 166 aa, Homo sapiens
MRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738586 - protein, 186 aa, Homo sapiens
MKSDFYFQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738587 - protein, 224 aa, Homo sapiens [sequence omitted]

SEQ ID NO: 738588 - protein, 166 aa, Homo sapiens; identical to SEQ ID NO: 738585

SEQ ID NO: 738589 - protein, 166 aa, Homo sapiens; identical to SEQ ID NO: 738585

SEQ ID NO: 738590 - protein, 210 aa, Homo sapiens
AGSLPACASGVRALHNGGSEELAVAQRNFILQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738591 - protein, 166 aa, Homo sapiens; identical to SEQ ID NO: 738585

SEQ ID NO: 738592 - protein, 237 aa, Homo sapiens
RSVAPIFRVQSKVRVSLVGGQPLEGERMYHQDMSNQHWRPNSGTYRLRSKPCVRFLCIRKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738593 - protein, 210 aa, Homo sapiens
LGHFRRVRLASARCTMAALKSWLSRSVTSFFRYRQCLCVPVVANFKKRCFSELIRPWHKTVTIGFGVTLCAVPIAQAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738594 - protein, 308 aa, Homo sapiens
LGHFRRVRLASARCTMAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTEVFSSKLEEEDACHSPLPVNIVLKVLVNAVRSKCSTDELIKCIYPDGEIHYLAAGADQASITARNHIQLVKLQVEEVHQLSRKAETKLAEAQIEELRQKTQEEGEERAESEQEAYLRED

SEQ ID NO: 738595 - protein, 99 aa, Homo sapiens
TAWVDPRVRYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 738596 - protein, 1438 aa, Homo sapiens
RLREASPCDFREETSLRSVVAARPQTLCALSPAPAAQPSPVRPAETMDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGSPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVGLFVSILILSLVFASRLRPASRAPLLFRPDTNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTRKLYFAQSHKPPFHGRVCMAPPGCLLSSSPDGPTKGFFFVPSEKVPKARLSATFGFNPCVNTGCGKPAVRPLVDTGAMVFVVFGIIGVNRTRQVDNHVIGDPGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 738597 - protein, 278 aa, Homo sapiens
MSRYLKNLLEQTTYKGKSSFQTYSDYLRWESFLQQQLQALPEGSVLRRGFQTCEHWKQIFMEIVGVQSALCGLVLSLLICVAAVAVFTTHILLLLPVLLSILGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 738598 - protein, 979 aa, Homo sapiens
RLREASPCDFREETSLRSVVAARPQTLCALSPAPAAQPSPVRPAETMDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGSPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVGLFVSILILSLVFASRLRPASRAPLLFRPDTNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTR

SEQ ID NO: 738599 - protein, 278 aa, Homo sapiens; identical to SEQ ID NO: 738597

SEQ ID NO: 738600 - protein, 1424 aa, Homo sapiens
RLREASPCDFREETSLRSVVAARPQTLCALSPAPAAQPSPVRPAETMDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGSPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVAGSAPPAGPRYSSGLITNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTRKLYFAQSHKPPFHGRVCMAPPGCLLSSSPDGPTKGFFFVPSEKVPKARLSATFGFNPCVNTGCGKPAVRPLVDTGAMVFVVFGIIGVNRTRQVDNHVIGDPGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 738601 - protein, 1542 aa, Homo sapiens
RLREASPCDFREETSLRSVVAARPQTLCALSPAPAAQPSPVRPAETMDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGSPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVAGSAPPAGPRYSSGLITNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTRKLYFAQSHKPPFHGRVCMAPPGCLLSSSPDGPTKGFFFVPSEKVPKARLSATFGFNPCVNTGCGKPAVRPLVDTGAMVFVVFGIIGVNRTRQVDNHVIGDPGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGTWARGWQAPCWEGREQTVSPVAPGSLQASEPFTVTSQGRLIGLSLLHVCAPEQSRGTQVVALSSVMCYCTCPLPQGSPRCALFLLSPEGGGWTPDLPVPLRPPGRGIRAAPPAVSYAGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 738602 - protein, 496 aa, Homo sapiens
PGLSPRLTERPGPACFSLGKGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGTWARGWQAPCWEGREQTVSPVAPGSLQASEPFTVTSQGRLIGLSLLHVCAPEQSRGTQVVALSSVMCYCTCPLPQGSPRCALFLLSPEGGGWTPDLPVPLRPPGRGIRAAPPAVSYAGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 738603 - protein, 499 aa, Homo sapiens
PGTVATRDLDHALALSMSLLAERGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGTWARGWQAPCWEGREQTVSPVAPGSLQASEPFTVTSQGRLIGLSLLHVCAPEQSRGTQVVALSSVMCYCTCPLPQGSPRCALFLLSPEGGGWTPDLPVPLRPPGRGIRAAPPAVSYAGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 738604 - protein, 77 aa, Homo sapiens
FGNYTADLVLSSGREVQQADRAQVGVQWLTDLCLGTAIRLRPLCAGSGPSFITGWYWHQPGGAVHGAGCAGRDVLRS

SEQ ID NO: 738605 - protein, 103 aa, Homo sapiens [sequence omitted]

SEQ ID NO: 738606 - protein, 114 aa, Homo sapiens [sequence omitted]

SEQ ID NO: 738607 - protein, 277 aa, Homo sapiens
GVQRARRWETSHTVTEMSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSEVVKRYNREHLTVWGNANYEHCRNSATKRIQIFLYSSVYNVVLPHSWPFLHWALALVPIREQFFEIPKASIILELKRNHTPWSQKSQSFSSGFWISY

SEQ ID NO: 738608 - protein, 115 aa, Homo sapiens
GVQRARRWETSHTVTEMSSTAAFYLLSTLGGYLVTSFLLLKYPTLLHQRKKQRFLSKHISHRGGAGENLENTMAAFQHAVKIGTDMLELDCHITKDEQVVVSHDENLKRAMGLQV

SEQ ID NO: 738609 - protein, 150 aa, Homo sapiens
GVQRARRWETSHTVTEMSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRGNIFCLWLKHLC

SEQ ID NO: 738610 - protein, 112 aa, Homo sapiens
LPPSAPPSADDNIKTPAERLRGPLPPSADDNLKTPSERQLISPSTLKTRQNKLQEMLLEGGKGKAKDEAWGPPSTLPLCSPHSITLQSLQIFQGKEKTKVCCNALPQYSFPF

SEQ ID NO: 738611 - protein, 118 aa, Homo sapiens
MCVPLTPSSLFLSLCLCRLSRWLFKNEEPLLECSGQSTELLLKSARRGCNRNPHASSTAPPDGEYPSRRDSPPSLTERSPTRTVAEGAGLGFSPSLPAWLSVAQGCKMKRRGKANSKF

SEQ ID NO: 738612 - protein, 194 aa, Homo sapiens
MCVPLTPSSLFLSLCLCRLSRWLFKNEEPLLECSGQSTELLLKSARRGCNRQQKGKRLPEIRTPAPPPRPMVPVPLGIVLYATSSQEWQAVESLAFVGPLDIWQRTRKPRFPSVSPSAGKLQGASCPAQCHGTVGPGATMPGISTRYSFEIFMMKLAPIQGLSGGVCGSAANLSLMSVRPLSWTFSPAADRVSL

SEQ ID NO: 738613 - protein, 118 aa, Homo sapiens
FELGLCASPSPPPLFFFLSVSVVSLAGFLKMRNRSLNVLDRAQNCFLSQPGAVAIDSKKVNVCLKSARQLHRPARWSQFLWESSCMQHLHKSGRQLNLWPSWDHWTSGREPGNHGSLL

SEQ ID NO: 738614 - protein, 92 aa, Homo sapiens
IFSGMKLYPCHTKDRVEEISLFDGTRGFYCKTFYAEALVYMKASLSKSCLHWLQESCLHWLQNWDEGGSLVESKAKRNSNWIHIKEEKDGFV

SEQ ID NO: 738615 - protein, 197 aa, Homo sapiens [sequence omitted]

SEQ ID NO: 738616 - protein, 409 aa, Homo sapiens
MEEGGSTGSAGSDSSTSGSGGAQQRELERMAEVLVTGEQLRLRLHEEKVIKDRRHHLKTYPNCFVAKELIDWLIEHKEASDRETAIKLMQKLADRGIIHHVCDEHKEFKDVKLFYRFRKDDGTFPLDNEVKAFMRGQRLYEKLMSPENTLLQPREEEGVKYERTFMASEFLDWLVQEGEATTRKEAEQLCHRLMEHGIIQHVSNKHPFVDSNLLYQFRMNFRRRRRLMELLNEKSPSSQETHDSPFCLRKQSHDNRKSTSFMSVSPSKEIKIVSAVRRSSMSSCGSSGYFSSSPTLSSSPPVLCNPKSVLKRPVTSEELLTPGAPYARKTFTIVGDAVGWGFVVRGSKPCHIQAVDPSGPAAAAGMKVCQFVVSVNGLNVLHVDYRTVSNLILTGPRTIVMEVMEELEC

SEQ ID NO: 738617 - protein, 409 aa, Homo sapiens; identical to SEQ ID NO: 738616

SEQ ID NO: 738618 - protein, 159 aa, Homo sapiens
MEEGGSTGSAGSDSSTSGSGGAQQRELERMAEVLVTGEQLRLRLHEEKVIKDRRHHLKTYPNCFVAKELIDWLIEHKEASDRETAIKLMQKLADRGIIHHVCDEHKEFKDVKLFYRFRKDDGTFPLDNEVKAFMRGQRLYEKYVPHEIPPVILTYRKKQ

SEQ ID NO: 738619 - protein, 385 aa, Homo sapiens
MEEGGSTGSAGSDSSTSGSGGAQQRELERMAEVLVTGEQLRLRLHEEKVIKDRRHHLKTYPNCFVAKELIDWLIEHKEASDRETAIKLMQKLADRGIIHHVCDEHKEFKDVKLFYRFRKDDGTFPLDNEVKAFMRGQRLYEKLMSPENTLLQPREEEGVKYERTFMASEFLDWLVQEVSNKHPFVDSNLLYQFRMNFRRRRRLMELLNEKSPSSQETHDSPFCLRKQSHDNRKSTSFMSVSPSKEIKIVSAVRRSSMSSCGSSGYFSSSPTLSSSPPVLCNPKSVLKRPVTSEELLTPGAPYARKTFTIVGDAVGWGFVVRGSKPCHIQAVDPSGPAAAAGMKVCQFVVSVNGLNVLHVDYRTVSNLILTGPRTIVMEVMEELEC

SEQ ID NO: 738620 - protein, 409 aa, Homo sapiens; identical to SEQ ID NO: 738616

SEQ ID NO: 738621 - protein, 344 aa, Homo sapiens
MEEGGSTGSAGSDSSTSGSGGAQQRELERMAEVLVTGEQLRLRLHEEKVIKDRRHHLKTYPNCFVAKELIDWLIEHKEASDRETAIKLMQKLADRGIIHHVCDEHKEFKDVKLFYRFRKDDGTFPLDNEVKAFMRGQRLYEKLMSPENTLLQPREEEGVKYERTFMASEFLDWLVQEGEATTRKEAEQLCHRLMEHGIIQHVSNKHPFVDSNLLYQFRMNFRRRRRLMELLNEKSPSSQETHDSPFCLRKQSHDNRKSTSFMSVSPSKEIKIVSAVRRSSMSSCGSSGYFSSSPTLSSSPPVLCNPKSVLKRPVTSEELLTPGAPYARKTFTIVGWLAEGNELD

SEQ ID NO: 738622 - protein, 66 aa, Homo sapiens
MGPATANSGKQSLGQPWAAQPPGRIAHCSVSAEKVYMTSGILERPLPPGLATKPPCPAEPCPPGPA

SEQ ID NO: 738623 - protein, 120 aa, Homo sapiens
RGTDLCAAQAAARTHRARLLRAPARPRGARGAGEARGLPLAAWSAAPCAHPPRTWGPSPREDGVLDDLQSRGAGVWNALSCILFIQSCENKKREGISAMDLNHWGRPTHPDPKGSLLKQL

SEQ ID NO: 738624 - protein, 255 aa, Homo sapiens
MVSWMISRAVVLVFGMLYPAYYSYKAVKTKNVKEYVRWMMYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKSQGAITERLRSFSMHDLTTIQGDEPVGQRPYQPLPEAKKKSKPAPSESAGYGIPLKDGDEKTDEEAEGPYSDNEMLTHKGLRRSQSMKSVKTTKGRKEVRYGSLKYKVKKRPQVYF

SEQ ID NO: 738625 - protein, 255 aa, Homo sapiens; identical to SEQ ID NO: 738624

SEQ ID NO: 738626 - protein, 146 aa, Homo sapiens
MVSWMISRAVVLVFGMLYPAYYSYKAVKTKNVKEYVRWMMYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKVIVHLPF

SEQ ID NO: 738627 - protein, 114 aa, Homo sapiens
MAKAFEHQAEAPGFLLQAEGSQDRMSSRGGPGAGRGGRGDRRQDSCEEAAGMGRGDGAGPKAEAVSTGDRCRHPGRPRLGRPLLSFCPLLPQHVTPGTARASDVSREVGSEIYA

SEQ ID NO: 738628 - protein, 130 aa, Homo sapiens
FLCWGLDFGRHEFQTVNCLCLIININDSCQLSACFSPIFKVGSQNVQSQQCKSIQGKLSKLADDRTTAVSHLKTTHLTRGKSMSEDWNKVNLLPAPFLEGAFEIFRSSSHSSETTFLFSFFPFFSLSQRI

SEQ ID NO: 738629 - protein, 628 aa, Homo sapiens
MDSGSSSSDSAPDCWDQVDMESPGSAPSGDGVSSAVAEAQREPLSSAFSRKLNVNAKPFVPNVHAAEFVPSFLRGPTQPPTLPAGSGSNDETCTGAGYPQGKRMGRGAPVEPSREEPLVSLEGSNSAVTMELSEPVVENGEVEMALEESWEHSKEVSEAEPGGGSSGDSGPPEESGQEMMEEKEEIRKSKSVIVPSGAPKKEHVNVVFIGHVDAGKSTIGGQIMFLTGMVDKRTLEKYEREAKEKNRETWYLSWALDTNQEERDKGKTVEVGRAYFETERKHFTILDAPGHKSFVPNMIGGASQADLAVLVISARKGEFETGFEKGGQTREHAMLAKTAGVKHLIVLINKMDDPTVNWSIERYEECKEKLVPFLKKVGFSPKKDIHFMPCSGLTGANIKEQSDFCPWYTGLPFIPYLDNLPNFNRSIDGPIRLPIVDKYKDMGTVVLGKLESGSIFKGQQLVMMPNKHNVEVLGILSDDTETDFVAPGENLKIRLKGIEEEEILPGFILCDPSNLCHSGRTFDVQIVIIEHKSIICPGYNAVLHIHTCIEEVEITALISLVDKKSGEKSKTRPRFVKQDQVCIARLRTAGTICLETFKDFPQMGRFTLRDEGKTIAIGKVLKLVPEKD

SEQ ID NO: 738630 - protein, 507 aa, Homo sapiens
MDSGSSSSDSAPDCWDQVDMESPGSAPSGDGVSSAVAEAQREPLSSAFSRKLNVNAKPFVPNVHAAEFVPSFLRGPTQPPTLPAGSGSNDETCTGAGYPQGKRMGRGAPVEPSREEPLVSLEGSNSAVTMELSEPVVENGEVEMALEESWEHSKEVSEAEPGGGSSGDSGPPEESGQEMMEEKEEIRKSKSVIVPSGAPKKEHVNVVFIGHVDAGKSTIGGQIMFLTGMVDKRTLEKYEREAKEKNRETWYLSWALDTNQEERDKGKTVEVGRAYFETERKHFTILDAPGHKSFVPNMIGGASQADLAVLVISARKGEFETGFEKGGQTREHAMLAKTAGVKHLIVLINKMDDPTVNWSIERYEECKEKLVPFLKKVGFSPKKDIHFMPCSGLTGANIKEQSDFCPWYTGLPFIPYLDNLPNFNRSIDGPIRLPIVDKYKDMGTVVLGKLESGSIFKGQQLVMMPNKHNVEVLGILSDDTETDFVAPGENFVILVTSAILDARLMFR

SEQ ID NO: 738631 - protein, 115 aa, Homo sapiens
FETNARSVLFAGDNMYSCEKCKKLRNGVKFCKVQNFPEILCIHLKRFRHELMFSTKISTHVSFPLEGLDLQPFLAKDSPAQIVTYDLLSVICHHGTASSKYIGLTVVPRFKKKLK

SEQ ID NO: 738632 - protein, 1000 aa, Homo sapiens
GPGDTGRSRGCCGKWPVQEADPPRAALRGRFPALLTRHCPSPRAEKEKRSLRRCGCRPLLVELAGPAGQAVEVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGDPPGPIDNTKIAVTKCGNVMLRQGADSGQISEETWNFLQSIYGGGPEVILRPPVVHVDPDILQAEEKIEVETRSL

SEQ ID NO: 738633 - protein, 836 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRVKK

SEQ ID NO: 738634 - protein, 116 aa, Homo sapiens
DFCCKFKYTKFFCRLIDFLFSPLRLRNGVKFCKVQNFPEILCIHLKRFRHELMFSTKISTHVSFPLEGLDLQPFLAKDSPAQIVTYDLLSVICHHGTASSKYIGLTVVPRFKKKLK

SEQ ID NO: 738635 - protein, 139 aa, Homo sapiens
MIIYFNNSLSNTPNSLKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRVKK

SEQ ID NO: 738636 - protein, 252 aa, Homo sapiens
MEPSLLQFYISRQWLNKFKTFAEPGPISNNDFLCIHGGSSNTSRNIEDLIMKINKKIWDSLTYLTGRRTYLKPIMVITPTSHAVANPSYHHSYEMNSNPESHPIIKLLPKLPLNMTKHPSPPPRIYMKSASLIQLRNEYTHIIIKTHMKSYISGTRQTAYSNESNVGGESHSYYELEIDNKNTARNIIEIISRAHAILHNSLTHITNLVIELFKRSNFHYNVNSKPDAEAELKIRKSANYRILKPSPYYDHH

SEQ ID NO: 738637 - protein, 851 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRILQVLLTILRLQSLNVVM

SEQ ID NO: 738638 - protein, 851 aa, Homo sapiens; identical to SEQ ID NO: 738637

SEQ ID NO: 738639 - protein, 731 aa, Homo sapiens
SDCFTLKGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRILQVLLTILRLQSLNVVM

SEQ ID NO: 738640 - protein, 625 aa, Homo sapiens
DDALLTRYVSAGIIPPMYYIEACKPPILPHSFRNKLNPHSGYTQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRILQVLLTILRLQSLNVVM

SEQ ID NO: 738641 - protein, 396 aa, Homo sapiens [sequence omitted]

SEQ ID NO: 738642 - protein, 475 aa, Homo sapiens
RPPTTTKFAAASTGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGDPPGPIDNTKIAVTKCGNVMLRQGADSGQISEETWNFLQSIYGGGPEVILRPPVVHVDPDILQAEEKIEVETRSL

SEQ ID NO: 738643 - protein, 713 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYR

SEQ ID NO: 738644 - protein, 942 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGDPPGPIDNTKIAVTKCGNVMLRQGADSGQISEETWNFLQSIYGGGPEVILRPPVVHVDPDILQAEEKIEVETRSL

SEQ ID NO: 738645 - protein, 192 aa, Homo sapiens
MFERNIIKSMKQICLYIFLGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGDPPGPIDNTKIAVTKCGNVMLRQGADSGQISEETWNFLQSIYGGGPEVILRPPVVHVDPDILQAEEKIEVETRSL

SEQ ID NO: 738646 - protein, 942 aa, Homo sapiens; identical to SEQ ID NO: 738644

SEQ ID NO: 738647 - protein, 900 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGGKWLTEKFFFGKLFVFLFDKYFLNICVHLGLHY

SEQ ID NO: 738648 - protein, 778 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGKNSCNANR

SEQ ID NO: 738649 - protein, 722 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRCSSKKSWLY

SEQ ID NO: 738650 - protein, 687 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSKYIGLTVVPRFKKKLK

SEQ ID NO: 738651 - protein, 417 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASGDNLVVCS

SEQ ID NO: 738652 - protein, 152 aa, Homo sapiens
HAATDSLNPPRLHVTICTVVKNPKRLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRCSSKKSWLY

SEQ ID NO: 738653 - protein, 123 aa, Homo sapiens
VYLFFSFSDPPELGAGSLCTEWTHRQLFVECLGNAHGFCPQGRGLTALMQGAPLSFLASSFFLLCAFSQNNDSHSFPSLLPLPHLPYTNLCPPWLDTLCCTAENELKIKTHSKECPPYIFCEL

SEQ ID NO: 738654 - protein, 93 aa, Homo sapiens
ANVQSFTQRPQQQPLTVWMLNRGRKPAQGTLTVICPIGPGHLLTSTITESVCVPRRNKYHSRTLPAAQHCQWLVTAVPTALGLVIRAGSKKLC

SEQ ID NO: 738655 - protein, 120 aa, Homo sapiens
LVNLPTKPAPFPARLGRLNAFWRIWPCLMEMCTKASNTWRVTQCESSGDGELLGLRVAQGARRPCLLPWPSLPPAPCKAIGERLGGGRDKRNQASLKATAVVSRLTAPSSPQTPTLSLRS

SEQ ID NO: 738656 - protein, 89 aa, Homo sapiens
RQPPGILRGGPDRAGGGERKPTGAGPPLTRRLRLPPPGLWAQRAQMPGRTPPPAAGTPIAALEPLGRRNWGLHRHLLLPSPRSLPHLLI

SEQ ID NO: 738657 - protein, 89 aa, Homo sapiens; identical to SEQ ID NO: 738656

SEQ ID NO: 738658 - protein, 89 aa, Homo sapiens; identical to SEQ ID NO: 738656

SEQ ID NO: 738659 - protein, 89 aa, Homo sapiens; identical to SEQ ID NO: 738656

SEQ ID NO: 738660 - protein, 101 aa, Homo sapiens
GWYRVGGGERSSIQEPSFRMEKALEEANALQEGHSVPEINSDTDKSETEESIVTEELIVVTSYTLGQCRQSEKEKMEQKAISKRFKFEEPLLQEIPGEFIY

SEQ ID NO: 738661 - protein, 476 aa, Homo sapiens
AGRGARGGPELPVVCLPQSERRAGESGCLKAPRTGTRSRGRVRDPPAARSEQAARKEAGLNTMIPLEKPGSGGSSPGATSGSGRAGRGLSGPCRPPPPPQARGLLTEIRAVVRTEPFQDGYSLCPGRELGRGKFAVVRKCIKKDSGKEFAAKFMRKRRKGQDCRMEIIHEIAVLELAQDNPWVINLHEVYETASEMILVLEYAAGGEIFDQCVADREEAFKEKDVQRLMRQILEGVHFLHTRDVVHLDLKPQNILLTSESPLGDIKIVDFGLSRILKNSEELREIMGTPEYVAPEILSYDPISMATDMWSIGVLTYVMLTGISPFLGNDKQETFLNISQMNLSYSEEEFDVLSESAVDFIRTLLVKKPEDRATAEECLKHPWLTQSSIQEPSFRMEKALEEANALQEGHSVPEINSDTDKSETEESIVTEELIVVTSYTLGQCRQSEKEKMEQKAISKRFKFEEPLLQEIPGEFIY

SEQ ID NO: 738662 - protein, 476 aa, Homo sapiens; identical to SEQ ID NO: 738661

SEQ ID NO: 738663 - protein, 476 aa, Homo sapiens; identical to SEQ ID NO: 738661

SEQ ID NO: 738664 - protein, 476 aa, Homo sapiens; identical to SEQ ID NO: 738661

SEQ ID NO: 738665 - protein, 369 aa, Homo sapiens
AGRGARGGPELPVVCLPQSERRAGESGCLKAPRTGTRSRGRVRDPPAARSEQAARKEAGLNTMIPLEKPGSGGSSPGATSGSGRAGRGLSGPCRPPPPPQARGLLTEIRAVVRTEPFQDGYSLCPGRELGRGKFAVVRKCIKKDSGKEFAAKFMRKRRKGQDCRMEIIHEIAVLELAQDNPWVINLHEVYETASEMILVLEYAAGGEIFDQCVADREEAFKEKDVQRLMRQILEGVHFLHTRDVVHLDLKPQNILLTSESPLGDIKIVDFGLSRILKNSEELREIMGTPEYVAPEILSYDPISMATDMWSIGVLTYVMLTGISPFLGNDKQETFLNISQMNLSYSEEEFDVLSESAVDFIRTLLVKKPE

SEQ ID NO: 738666 - protein, 476 aa, Homo sapiens; identical to SEQ ID NO: 738661

SEQ ID NO: 738667 - protein, 103 aa, Homo sapiens
YSDLSVSELISDSSIQEPSFRMEKALEEANALQEGHSVPEINSDTDKSETEESIVTEELIVVTSYTLGQCRQSEKEKMEQKAISKRFKFEEPLLQEIPGEFIY

SEQ ID NO: 738668 - protein, 80 aa, Homo sapiens
TTQPEKYEIDKVIIETKTESYNKIKENRTAKITSNEKHLESLKNAGSLLRALERLAPGSGSFADSAVAPLALEILQAVGH

SEQ ID NO: 738669 - protein, 534 aa, Homo sapiens
DSPSTCIRAKAFLVLLYILIYNREMLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGLTASEEFIKITLSAFEAIIQYPILLKDYRSTVVDYILPPLVSLVQSQNVEWRLFSLRLLSETTSLLVNQEFGDGKEKASVDSDSNLLALIRDVLLPQYEHILLEPDPVPAYALKLLVAMTEHNPTFTRLVEESKLIPLIFEVTLEHQESILGNTMQSVIALLSNLVACKDSNMELLYEQGLVSHICNLLTETATLCLDVDNKNNNEMAAPLLFSLLDILHSMLTYTSGIVRLALQAQKSGSGEDPQAAEDLLLLNRPLTDLISLLIPLLPNEDPEIFDVSSKCLSILVQLYGGENPDSLSPENVEIFAHLLTSKEDPKEQKLLLRILRRMITSNEKHLESLKNAGSLLRALERLAPGSGSFADSAVAPLALEILQAVGH

SEQ ID NO: 738670 - protein, 534 aa, Homo sapiens; identical to SEQ ID NO: 738669

SEQ ID NO: 738671 - protein, 296 aa, Homo sapiens
DSPSTCIRAKAFLVLLYILIYNREMLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGLTASEEFIKITLSAFEAIIQYPILLKDYRSTVVDYILPPLVSLVQSQNVEWRLFSLRLLSETTSLLVNQEFGDGKEKASVDSDSNLLALIRDVLLPQYEHILLEPDPVPAYALKLLVAMTEHNPTFTRYWKFKFLFLVSHL

SEQ ID NO: 738672 - protein, 156 aa, Homo sapiens
DSPSTCIRAKAFLVLLYILIYNREMLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGC

SEQ ID NO: 738673 - protein, 762 aa, Homo sapiens
SGGIAMLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 738674 - protein, 486 aa, Homo sapiens
SGGIAMLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPIRSPTQRVPRGTATHRAARS

SEQ ID NO: 738675 - protein, 457 aa, Homo sapiens
SGGIAMLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPVGHKATAATVAWVSGQRRMIRTAVWTQMSARLPVCASRCVSTTLVASSVIVARDMSWRLMASAAALQGPWVPRLPRTSEMSCWMTGRMRKMKTRPGRPSTVAGRRCLGSCGWSLRSRLTLPWPIDRASQRTESHRYPTRSPPGHPRAQLDRWLPAPQAQPGSSLNH

SEQ ID NO: 738676 - protein, 762 aa, Homo sapiens; identical to SEQ ID NO: 738673

SEQ ID NO: 738677 - protein, 309 aa, Homo sapiens
EGGSQRVSQLWSSSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 738678 - protein, 127 aa, Homo sapiens
SQGLCLRTFLRPSMRSSHRGPGFLLRPFSVPGHLFSLLLSPNLHLPPSSLSVLSHPCPWFRSHSTCLSGQAQGYRCSHLFPATFPPIFGRQKSQLSLEGRPGHPAGSSLRGAWSLVLFPSQPGCRPL

SEQ ID NO: 738679 - protein, 204 aa, Homo sapiens
GDASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVMRWDGSMFRLLQQLPSRGAHVFQPLLIARDQLAILGSDFAFSQVLRLEPDKGLLEPLQELGPPALVAPRAFAHITMAGRRFLFAACFKGPTQIYQHHEIDLSA

SEQ ID NO: 738680 - protein, 204 aa, Homo sapiens; identical to SEQ ID NO: 738679

SEQ ID NO: 738681 - protein, 103 aa, Homo sapiens
TYSPSATASSSTSTTPSGAPRSLQSPWPAPPPLRPPESRACLAQAGRTEGQTDSSSLALRRCCLTRPRVGRTGIAPRAPRGVISGWLHASAEDPSSCQCHLSA

SEQ ID NO: 738682 - protein, 103 aa, Homo sapiens; identical to SEQ ID NO: 738681

SEQ ID NO: 738683 - protein, 103 aa, Homo sapiens; identical to SEQ ID NO: 738681

SEQ ID NO: 738684 - protein, 111 aa, Homo sapiens
EAPDPYTQAAAVAGSQLSQDSATVEESPGKLPATWFRPTASKRNCSAAPGVMQKMGSFWSTHGLGDRAWTAAATMQLMGLATGLHLSAGPPRRSCDISSYFRTNAEDCHGV

SEQ ID NO: 738685 - protein, 486 aa, Homo sapiens
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDPCVLGTHQCQHVCISDGEGKHHCECSQGYTLNADKKTCSALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 738686 - protein, 486 aa, Homo sapiens; identical to SEQ ID NO: 738685

SEQ ID NO: 738687 - protein, 110 aa, Homo sapiens
HLRPRTRPFCGGSPQRPSAQLRRLTRDAPKLLKAFQSFPTLENRPVRVSPSSRTPPWRGEERTGNAEPPRRLGETDPLPLPAHFPVLVTRGAAHSLSGGTSAKTPEEMKR

SEQ ID NO: 738688 - protein, 32 aa, Homo sapiens
MGGLRGGAEPGPLAPTLVSFRSAGASWDPAVC

SEQ ID NO: 738689 - protein, 119 aa, Homo sapiens
LGDRVRLCQKERKEGERKRKKERKKERKKERKRKKIETIWHEIPLLPASLPQKYLGLPALTSSPPVSENWVRHLYRHQNLFPSALDSSAFTPHIFPRGLCSTSFHLPLSLSLSLALSMC

SEQ ID NO: 738690 - protein, 107 aa, Homo sapiens
RESENWLDEGEKAHKLLYVLTYFILQQSCEADTVTTSTPIVLARIQWLRDLPKAIELIAKLELEPMSSAAASTAGPPQPSRLDTVSSCASQLRGIRNPSPCRGFLES

SEQ ID NO: 738691 - protein, 46 aa, Homo sapiens
MTRYQLQNKGGPGVPLQLSGGRTATSNGPTSAHCVTGYREYPWVRP

SEQ ID NO: 738692 - protein, 182 aa, Homo sapiens
MAEFPSKVSTRTSSPAQGAEASVSALRPDLGFVRSRLGALMLLQLVLGLLVWALIADTPYHLYPAYGWVMFVAVFLWLVTIVLFNLYLFQLHMKLYMVPWPLVLMIFNISATVLYITAFIACSAAVDLTSLRGTRPYNQRAAASFFACLVMIAYGVSAFFSYQAWRGVGSNAATSQMAGGYA

SEQ ID NO: 738693 - protein, 182 aa, Homo sapiens; identical to SEQ ID NO: 738692

SEQ ID NO: 738694 - protein, 182 aa, Homo sapiens; identical to SEQ ID NO: 738692

SEQ ID NO: 738695 - protein, 182 aa, Homo sapiens; identical to SEQ ID NO: 738692

SEQ ID NO: 738696 - protein, 182 aa, Homo sapiens; identical to SEQ ID NO: 738692

SEQ ID NO: 738697 - protein, 113 aa, Homo sapiens
MFVAVFLWLVTIVLFNLYLFQLHMKLYMVPWPLVLMIFNISATVLYITAFIACSAAVDLTSLRGTRPYNQRAAASFFACLVMIAYGVSAFFSYQAWRGVGSNAATSQMAGGYA

SEQ ID NO: 738698 - protein, 260 aa, Homo sapiens
AEITPLHPNLGDRARLCLKKKKRNRKRSGAVAHNCNLKHFGRPRWEDHLCPGIWDQRGNIIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSTLISVGCDLDKKIVIQNKVSACSMGILDPLTLQDNYSFIIEKEFYDPGFQGQQSSEDLHVFYSYQQLGCPLLVYYDTLWKPVVEL

SEQ ID NO: 738699 - protein, 73 aa, Homo sapiens
MTCSPCVYNPFLHVCTRSEQNPASTGEDQMRDGGCSSKVWDGGLREPLGVAKALHTSELQTLKKRAELHGAAR

SEQ ID NO: 738700 - protein, 73 aa, Homo sapiens; identical to SEQ ID NO: 738699

SEQ ID NO: 738701 - protein, 1893 aa, Homo sapiens [sequence omitted]

SEQ ID NO: 738702 - protein, 1839 aa, Homo sapiens
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLHKWSIKKERNSFQERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEELKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 738703 - protein, 1952 aa, Homo sapiens
HHHHQRPKVDKITKMGKKQNRKTGNSKTQSASPPPKERSSSPATEQSWMENDFDELREEGFRRSNYSELRDDIQTKGKEVENFEKNLEECITRITNTEKCLKELMGAGRAIFSHQSRNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEELKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 738704 - protein, 543 aa, Homo sapiens
MDAFTGSGLKRKFDDVDVGSSVSNSDDEISSSDSADSCDSLNPPTTASFTPTSILKRQKQLRRKNVRFDQVTVYYFARRQGFTSVPSQGGSSLGMAQRHNSVRSYTLCEFAQEQEVNHREILREHLKEEKLHAKKMKLTKNGTVESVEADGLTLDDVSDEDIDVENVEVDDYFFLQPLPTKRRRALLRASGVHRIDAEEKQELRAIRLSREECGCDCRLYCDPEACACSQAGIKCQVDRMSFPCGCSRDGCGNMAGRIEFNPIRVRTHYLHTIMKLELESKRQVSRPAAPDEEPSPTASCSLTGAQGSETQDFQEFIAENETAVMHLQSAEELERLKAEEDSSGSSASLDSSIESLGVCILEEPLAVPEELCPGLTAPILIQAQLPPGSSVLCFTENSDHPTASTVNSPSYLNSGPLVYYQVEQRPVLGVKGEPGTEEGSASFPKEKDLNVFSLPVTSLVACSSTDPAALCKSEVGKTPTLEALLPEDCNPEEPENEDFHPSWSPSSLPFRTDNEEGCGMVKTSQQNEDRPPEDSSLELPLAV

SEQ ID NO: 738705 - protein, 543 aa, Homo sapiens; identical to SEQ ID NO: 738704

SEQ ID NO: 738706 - protein, 543 aa, Homo sapiens; identical to SEQ ID NO: 738704

SEQ ID NO: 738707 - protein, 543 aa, Homo sapiens; identical to SEQ ID NO: 738704

SEQ ID NO: 738708 - protein, 543 aa, Homo sapiens; identical to SEQ ID NO: 738704

SEQ ID NO: 738709 - protein, 543 aa, Homo sapiens; identical to SEQ ID NO: 738704

SEQ ID NO: 738710 - protein, 60 aa, Homo sapiens
MAQRHNSVRSYTLCEFAQEQEVNHREILREHLKEEKLHAKKMKLTKNGTVESVEADGLTL

SEQ ID NO: 738711 - protein, 153 aa, Homo sapiens
SGGLGQDVPAPIRASALRPDPIVSRSRGGSGRLLPGAPELPETPGPLCLPAGLPTALPPRPAALGAPRPSPRGPGLARSSLLPTGLGRRRQRGRQRPSREEAAAAGPVMGLGVRGGGCRLVLSRDRPSGGRGGVVKPRAVRMEGILMYLASWW

SEQ ID NO: 738712 - protein, 119 aa, Homo sapiens
SGGLGQDVPAPIRASALRPDPIVSRSRGGSGRLLPGAPELPETPGPLCLPAGLPTALPPRPAALGAPRPSPRGPGLARSSLLPTGLGRRRQRGRQRPSREEAAAAGPAQVTQPTATRPF

SEQ ID NO: 738713 - protein, 60 aa, Homo sapiens; identical to SEQ ID NO: 738710

SEQ ID NO: 738714 - protein, 60 aa, Homo sapiens; identical to SEQ ID NO: 738710

SEQ ID NO: 738715 - protein, 60 aa, Homo sapiens; identical to SEQ ID NO: 738710

SEQ ID NO: 738716 - protein, 532 aa, Homo sapiens
GPGRTEKGSALRVAGVTYLVSCFRDMAFNFGAPSGTSGTAAATAAPAGGFGGFGTTSTTAGSAFSFSAPTNTGTTGLFGGTQNKGFGFGTGFGTTTGTSTGLGTGLGTGLGFGGFNTQQQQQTTLGGLFSQPTQAPTQSNQLINTASALSAPTLLGDERDAILAKWNQLQAFWGTGKGYFNNNIPPVEFTQENPFCRFKAVGYSCMPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDIISEDISELQKNQTTSVAKIAQYKRKLMDLSHRTLQVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 738717 - protein, 121 aa, Homo sapiens
GPGRTEKGSALRVAGVTYLVSCFRDMAFNFGAPSGTSGTAAATAAPAGGFGGFGTTSTTAGSAFSFSAPTNTGTTGLFGGTQNKGFGFGTGFGTTTGTSTGLGTGLGTGLPFVALFLPSAL

SEQ ID NO: 738718 - protein, 149 aa, Homo sapiens
HIFYIVYFVIPQAVGYSCMPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGMFLESQSS

SEQ ID NO: 738719 - protein, 346 aa, Homo sapiens
GPGRTEKGSALRVAGVTYLVSCFRDMAFNFGAPSGTSGTAAATAAPAGGFGGFGTTSTTAGSAFSFSAPTNTGTTGLFGGTQNKGFGFGTGFGTTTGTSTGLGTGLGTGLGFGGFNTQQQQQTTLGGLFSQPTQAPTQSNQLINTASALSAPTLLGDERDAILAKWNQLQAFWGTGKGYFNNNIPPVEFTQENPFCRFKAVGYSCMPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEK

SEQ ID NO: 738720 - protein, 463 aa, Homo sapiens
GPGRTEKGSALRVAGVTYLVSCFRDMAFNFGAPSGTSGTAAATAAPAGGFGGFGTTSTTAGSAFSFSAPTNTGTTGLFGGTQNKGFGFGTGFGTTTGTSTGLGTGLGTGLGFGGFNTQQQQQTTLGGLFSQPTQAPTQSNQLINTASALSAPTLLGDERDAILAKWNQLQAFWGTGKGYFNNNIPPVEFTQENPFCRFKAVGYSCMPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDIISEDISELQKNQTTSVAKIAQYKRKLMDLSHRTLQVLIKQEIQRKSGYAIQADEEQLRVQLDTIQGELNAPTQFKDAESFWSSQI

SEQ ID NO: 738721 - protein, 327 aa, Homo sapiens
MPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDIISEDISELQKNQTTSVAKIAQYKRKLMDLSHRTLQVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 738722 - protein, 327 aa, Homo sapiens; identical to SEQ ID NO: 738721

SEQ ID NO: 738723 - protein, 128 aa, Homo sapiens
MDLSHRTLQVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 738724 - protein, 109 aa, Homo sapiens
MSGRLWSKAIFAGYKRGLRNQREHTALLKIEGVYARDETEFYLGKRCAYVYKAKNNTVTPGGKPNKTRVIWGKVTRAHGNSGMVRAKFRSNLPAKAIGHRIRVMLYPSR

SEQ ID NO: 738725 - protein, 109 aa, Homo sapiens; identical to SEQ ID NO: 738724

SEQ ID NO: 738726 - protein, 105 aa, Homo sapiens
MSGRLWSKAIFAGYKRGLRNQREHTALLKIEGVYARDETEFYLGKRCAYVYKAKNNTVTPGGKPNKTRVIWGKVTRAHGNSGMGFVPNFRSNLPAKGHLDNRIPS

SEQ ID NO: 738727 - protein, 114 aa, Homo sapiens
GAMAGHSLPDIVPFRSPVSQQAIFAGYKRGLRNQREHTALLKIEGVYARDETEFYLGKRCAYVYKAKNNTVTPGGKPNKTRVIWGKVTRAHGNSGMVRAKFRSNLPAKAIGHRI

SEQ ID NO: 738728 - protein, 80 aa, Homo sapiens
ARKTLAHHIGHLWWAADENNFIVGIELCPPGKRFMITMVASFVAMAGQFLMPGLAALCRDWQVLQALIICPFLLMLLYWS

SEQ ID NO: 738729 - protein, 281 aa, Homo sapiens
RCLPSSPWWGEDDRDESSEKHFEGGGAEGHTWKGDLFLGRCQVSAAFTQKPMMSEPGFFKVSQPAYPQSLSDCGRSQRSLSRGTELSCRRLSVKIQGAEAWARSTGLRCRRTGLNPSTTASTLRNLGDYSAPWNLISKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWS

SEQ ID NO: 738730 - protein, 175 aa, Homo sapiens
GYQKTLVLLTWIPALFIGFSQFSDSFLLDQPNFWCRGAGKGTELAGVTTTGRGGDMGNWTSLPTTPFATAPWEVLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWS

SEQ ID NO: 738731 - protein, 139 aa, Homo sapiens
PWVPAESSGQAGLTREWRPLVTPQEEMREHEGVADTTTRSTRPTAPRGADCESCLLPQSLTSIWWKHASFLLILQSQRRKGAGLKSPSKVGAETGERLAWGQSRCLGGKYLMGLESAEAQGGSKLHLLPAGTCGKSFSP

SEQ ID NO: 738732 - protein, 848 aa, Homo sapiens
RRRRHFSCWFRPHRVGCSSGRGGGPPELSGCPRLCPYSSQLSSLITARSKSARMSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 738733 - protein, 614 aa, Homo sapiens
ADSKGIPLIAQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 738734 - protein, 814 aa, Homo sapiens
RRRRHFSCWFRPHRVGCSSGRGGGPPELSGCPRLCPYSSQLSSLITARSKSARMSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQAPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 738735 - protein, 397 aa, Homo sapiens
HSKGHTFPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 738736 - protein, 848 aa, Homo sapiens; identical to SEQ ID NO: 738732

SEQ ID NO: 738737 - protein, 848 aa, Homo sapiens; identical to SEQ ID NO: 738732

SEQ ID NO: 738738 - protein, 762 aa, Homo sapiens
RRRRHFSCWFRPHRVGCSSGRGGGPPELSGCPRLCPYSSQLSSLITARSKSARMSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVGENCPSIL

SEQ ID NO: 738739 - protein, 826 aa, Homo sapiens
RRRRHFSCWFRPHRVGCSSGRGGGPPELSGCPRLCPYSSQLSSLITARSKSARMSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLDRIIAKLQSKEYSQY

SEQ ID NO: 738740 - protein, 848 aa, Homo sapiens; identical to SEQ ID NO: 738732

SEQ ID NO: 738741 - protein, 831 aa, Homo sapiens
RRRRHFSCWFRPHRVGCSSGRGGGPPELSGCPRLCPYSSQLSSLITARSKSARMSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWFHSTSKGIWKMSFTVCVHGEP

SEQ ID NO: 738742 - protein, 840 aa, Homo sapiens
RRRRHFSCWFRPHRVGCSSGRGGGPPELSGCPRLCPYSSQLSSLITARSKSARMSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQTKAFLICR

SEQ ID NO: 738743 - protein, 447 aa, Homo sapiens
RRRRHFSCWFRPHRVGCSSGRGGGPPELSGCPRLCPYSSQLSSLITARSKSARMSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGYTEDRVFEPPGQP

SEQ ID NO: 738744 - protein, 108 aa, Homo sapiens [sequence omitted]

SEQ ID NO: 738745 - protein, 129 aa, Homo sapiens
FFNTNILKITEQATLKLFIYQEAPKIPSQLNGTDFYGQLITKMRHHMQYVLRGFLKSIDQSINQSMYLCIYLPTYLPTYLPIYLPTYLPYLLFIEMESSHSVTHAGVQWRDLGSLQPPPLGDKSKTPAS

SEQ ID NO: 738746 - protein, 313 aa, Homo sapiens
MGNFDNANVTGEIEFAIHYCFKTHSLEICIKACKNLAYGEEKKKKCNPYVKTYLLPDRSSQGKRKTGVQRNTVDPTFQETLKYQVAPAQLVTRQLQVSVWHLGTLARRVFLGEVIISLATWDFEDSTTQSFRWHPLRAKAEKYEDSVPQSNGELTVRAKLVLPSRPRKLQEAQEGTDQPSLHGQLCLVVLGAKNLPVRPDGTLNSFVKGCLTLPDQQKLRLKSPVLRKQACPQWKHSFVFSGVTPAQLRQSSLELTVWDQALFGMNDRLLGGTRLGSKGDTAVGGDACSQSKLQWQKVLSSPNLWTDMTLVLH

SEQ ID NO: 738747 - protein, 313 aa, Homo sapiens; identical to SEQ ID NO: 738746

SEQ ID NO: 738748 - protein, 177 aa, Homo sapiens
MAQYTAELRRYINMLTKPRHVPWTRREIPAPGTLGPLHIPGHTLSPAQAPSPAPVPAPSRPLLGKQSICADQAWAHVPWARGCLQADMKPVGWHLGTVLPGMEKETKRTRWPSQSGVFPCCCPQRAQPAGLVTLPPAPYHSTGSASPALPSTLLALAEAHSLFLHRLNKASQSTKYL

SEQ ID NO: 738749 - protein, 156 aa, Homo sapiens
EKKKLKCLAYDFYPGKIDVHWTRAGEVQEPELRGDVLHGGNGTYLTWLLVHVPPQDTAPYSCHVQHSSLPSPSWCPGRPGRKQGLEAMWDLSPSSCPSCLMWELNHRNHGQWILKAQGAVWGDRQEVDLETEDWDACPELTRTQKPSHLEPPPAIV

SEQ ID NO: 738750 - protein, 71 aa, Homo sapiens
VCLFTCSGWSAMWCNYAHWSINFLGSSNSPASASRVAGTTGVCHHAQLIFVFLVETGFHHIGQDGLDLLIS

SEQ ID NO: 738751 - protein, 317 aa, Homo sapiens
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGGDNGEEGEEESVTGANAEGTTETGGQGKGTSKTTTSPNGGFEPTTPPQVYRTTSPPFGKTTTVEYEGEYEYTGVNEYDNGYEIYESENGEPRGDNYRAYEDEYSYFKGQGYDGYDGQNYYHHQ

SEQ ID NO: 738752 - protein, 317 aa, Homo sapiens; identical to SEQ ID NO: 738751

SEQ ID NO: 738753 - protein, 92 aa, Homo sapiens
MGPLQFRDVAIEFSLEEWHCLDTAQRNLYRNVMLENYSNLVFLGITVSKPDLITCLEQGRKPLTMKRNEMIAKPSVSFLQVHSESQSPLHDI

SEQ ID NO: 738754 - protein, 353 aa, Homo sapiens
MSKPPDLLLRLLRGAPRQRVCTLFIIGFKFTFFVSIMIYWHVVGEPKEKGQLYNLPAEIPCPTLTPPTPPSHGPTPGNIFFLETSDRTNPNFLFMCSVESAARTHPESHVLVLMKGLPGGNASLPRHLGISLLSCFPNVQMLPLDLRELFRDTPLADWYAAVQGRWEPYLLPVLSDASRIALMWKFGGIYLDTDFIVLKNLRNLTNVLGTQSRYVLNGAFLAFERRHEFMALCMRDFVDHYNGWIWGHQGPQLLTRVFKKWCSIRSLAESRACRGVTTLPPEAFYPIPWQDWKKYFEDINPEELPRLLSATYAVHVWNKKSQGTRFEATSRALLAQLHARYCPTTHEAMKMYL

SEQ ID NO: 738755 - protein, 353 aa, Homo sapiens; identical to SEQ ID NO: 738754

SEQ ID NO: 738756 - protein, 353 aa, Homo sapiens; identical to SEQ ID NO: 738754

SEQ ID NO: 738757 - protein, 163 aa, Homo sapiens
MSKPPDLLLRLLRGAPRQRVCTLFIIGFKFTFFVSIMIYWHVVGEPKEKGQLYNLPAEIPCPTLTPPTPPSHGPTPGNIFFLETSDRTNPNFLFMCSVESAARTHPESHVLVLMKGLPGGKGQPLLPTPSFFLSRDARGACMLCPFPQTGAGWGGSLGSGEAF

SEQ ID NO: 738758 - protein, 353 aa, Homo sapiens; identical to SEQ ID NO: 738754

SEQ ID NO: 738759 - protein, 164 aa, Homo sapiens
ALPSGRRAARPPGPRCPPPAAAGARDGFAAAASVWKGRVRVGKEGRLLSQGVSPGGLWAARIPTSLQWAAQAGQLPASDISEVPCSLPWEGPSLSYQAPGSQYHPQPMWIATPPSACPWEGTGQPLLPTPSFFLSRDARGACMLCPFPQTGAGWGGSLGSGEAF

SEQ ID NO: 738760 - protein, 212 aa, Homo sapiens
QSQDLSMAATRCLRWGLSRAGVWLLPPPARCPRRALHKQKDGTEFKSIYSLDKLYPESQGSDTAWRVPNGAKQADSDIPLDRLTISYCRSSGPGGQNVNKVNSKAEVRFHLATAEWIAEPVRQKIAITHKNKINRLGELILTSESSRYQFRNLADCLQKIRDMITEASQTPKEPTKEDVKLHRIRIENMNRERLRQKRIHSAVKTSRRVDMD

SEQ ID NO: 738761 - protein, 164 aa, Homo sapiens
YARSWRGSAEEGSDTAWRVPNGAKQADSDIPLDRLTISYCRSSGPGGQNVNKVNSKAEVRFHLATAEWIAEPVRQKIAITHKNKINRLGELILTSESSRYQFRNLADCLQKIRDMITEASQTPKEPTKEDVKLHRIRIENMNRERLRQKRIHSAVKTSRRVDMD

SEQ ID NO: 738762 - protein, 199 aa, Homo sapiens
QSQDLSMAATRCLRWGLSRAGVWLLPPPARCPRRALHKQKDGTEFKSIYSLDKLYPESQGSDTAWRVPNGAKQADSDIPLDRLTISYCRSSGPGGQNVNKVNSKAEVRFHLATAEWIAEPVRQKIAITHKNKINRLGELILTSESSRYQFRNLADCLQKIRDMITEASQTPKEPTKEDVKLHRIRIRNMNRGKLETLPL

SEQ ID NO: 738763 - protein, 208 aa, Homo sapiens
QSQDLSMAATRCLRWGLSRAGVWLLPPPARCPRRALHKQKDGTEFKSIYSLDKLYPESQGSDTAWRVPVSREGLDEKGRFVRLLGDVRNPRPIGRMWSYVGGLRDGRRGRGLAVCANLAGSGVLAVARDVQEPGRPAGYASFKAASFSTFVSLALKTKFQSQGEIRAFWPSKADNKGKRLPSCLLPFGTLQCPLSLVTPGRANKTASL

SEQ ID NO: 738764 - protein, 212 aa, Homo sapiens; identical to SEQ ID NO: 738760

SEQ ID NO: 738765 - protein, 212 aa, Homo sapiens; identical to SEQ ID NO: 738760

SEQ ID NO: 738766 - protein, 212 aa, Homo sapiens; identical to SEQ ID NO: 738760

SEQ ID NO: 738767 - protein, 198 aa, Homo sapiens
RVRYWDIDYPNCPRPRCPRRALHKQKDGTEFKSIYSLDKLYPESQGSDTAWRVPNGAKQADSDIPLDRLTISYCRSSGPGGQNVNKVNSKAEVRFHLATAEWIAEPVRQKIAITHKNKINRLGELILTSESSRYQFRNLADCLQKIRDMITEASQTPKEPTKEDVKLHRIRIENMNRERLRQKRIHSAVKTSRRVDMD

SEQ ID NO: 738768 - protein, 72 aa, Homo sapiens
QSQDLSMAATRCLRWGLSRAGVWLLPPPARCPRRALHKQKDGTEFKSIYSLDKLYPESQGSDTAWRVPTESR

SEQ ID NO: 738769 - protein, 93 aa, Homo sapiens
QSQDLSMAATRCLRWGLSRAGVWLLPPPARCPRRALHKQKDGTEFKSIYSLDKLYPESQGSDTAWRVPNGAKQADSDIPLERYLYLKGTPWIQ

SEQ ID NO: 738770 - protein, 125 aa, Homo sapiens
QSQDLSMAATRCLRWGLSRAGVWLLPPPARCPRRALHKQKDGTEFKSIYSLDKLYPESQGSDTAWRVPVSREGLDGRGVLSGCWVTLGTPGPLAGCGATSGGYVMVAAGGGWLSALTWPGVGCSL

SEQ ID NO: 738771 - protein, 41 aa, Homo sapiens
MCSISNEQLPGLQDNLWLTSPRTGHLLNLASSPHRMGTRFK

SEQ ID NO: 738772 - protein, 140 aa, Homo sapiens
MESLVLMKPRGSLIRSACPDCFLLFCFSFFHEAEGCASRMLTPTLHWLFIDNIHRSPWDWSLQECGAAPVQLKPVGDHLPFKLDLVPVARGGLLMSEGQNFQPQIMLRLPFLVPVSCEMPCTPTTPAQNGPAGPPCLRSS

SEQ ID NO: 738773 - protein, 124 aa, Homo sapiens
PCAVNPWTVLRATLPDLDCIQTEACGMKPSAVSKFLVPRQYVPRLPFKVAVMAVVSCTLRTVLSLTLTHSPGDGRVPGAFYASVLAFAGVSTAQTRVRDHPSSASMIPPTGWGRAVPGPEARPR

SEQ ID NO: 738774 - protein, 113 aa, Homo sapiens
QMPYTLTFLIFGSIVAFLLKPILSILFNTAAVYLPDREIPYPFHLLYVFHITYHPRYFTYLCLLFTVVSPGYNVSSMWAGAFVFFTDISQVPKTVPDTQKGLSKYVLNGFDLN

SEQ ID NO: 738775 - protein, 600 aa, Homo sapiens
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 738776 - protein, 565 aa, Homo sapiens
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKAQTPGSFSGSPAHGQYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 738777 - protein, 585 aa, Homo sapiens
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 738778 - protein, 234 aa, Homo sapiens
PLFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHL

SEQ ID NO: 738779 - protein, 248 aa, Homo sapiens
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHFVEGGDAGNREDQINRLIRRMN

SEQ ID NO: 738780 - protein, 81 aa, Homo sapiens
LAFRHPLQAQSCFQLLDHFCACLVAASPSPAFAFLQFLEAELHFSNGLFRPSSCVCIVPSGPELSHVIVTRPLELGRLWSW

SEQ ID NO: 738781 - protein, 138 aa, Homo sapiens [sequence omitted]

SEQ ID NO: 738782 - protein, 119 aa, Homo sapiens
LVKCLKSHQLHRLLPGQPSPQSTPSTALRLLNQAPTRQRKTKRARRTEDMSDMAGGTANRPLGTEQPRPTEAEASREQPRSAAQASRVQLGDWSFTTAAVATPSWLSNTTRLAENADSQ

SEQ ID NO: 738783 - protein, 113 aa, Homo sapiens
LTLRRFPPSPNITKGEHDSHPASSLWRTHLLTPLAPHHLIPSTKMRGRGWNGKISGERIEGKASFAEPAGLGMGAAALKRGHIDCHIGEDTVWREVGKRGVTRPFGFENKNKN

SEQ ID NO: 738784 - protein, 187 aa, Homo sapiens
DSPSPFSDSYSHLSGRPIRKKTEEEEKLLKLLQGIPRPQDGFTQWCEQMLHTLSATGSLDVPMAVAILKEVESPYDVHDYIRSCLGDTLEAKEFAKQFLERRAKQKASQQRQQQQEAWLSSASLQTAFQANHSTKLGPGEGSKAKRRALMLHSDPSILGELGWGRSGTSLAQGRRSPGESSDAASPR

SEQ ID NO: 738785 - protein, 175 aa, Homo sapiens
DSPSPFSDSYSHLSGRPIRKKTEEEEKLLKLLQGIPRPQDGFTQWCEQMLHTLSATGSLDVPMAVAILKEVESPYDVHDYIRSCLGDTLEAKEFAKQFLERRAKQKASQQRQQQQEAWLSSASLQTAFQANHSTKLGPGEGSKAKRRALMLHSDPSILGYSLHGSSGEIESVDDY

SEQ ID NO: 738786 - protein, 175 aa, Homo sapiens; identical to SEQ ID NO: 738785

SEQ ID NO: 738787 - protein, 76 aa, Homo sapiens
LVLRWVRTARIGHGASALVFFLPMEESYINFLAINQKVSCRPGRGSWKSSLGDRVRLHLKNKQTKKQKNKKLSVAY

SEQ ID NO: 738788 - protein, 253 aa, Homo sapiens [sequence omitted]

SEQ ID NO: 738789 - protein, 253 aa, Homo sapiens [sequence omitted]

SEQ ID NO: 738790 - protein, 148 aa, Homo sapiens
GLEAAEGAGARVRDSATREEIDWTTNELRNNLRSIEWDLEDLDETISIVEANPRKFNLDATELSIRKAFITSTRQVVRDMKDQMSTSSVQALAERKNRQALLGDSGSQNWSTGTTDKYGRLDRELQRANSHFIEEQQAQQQIGANGVP

SEQ ID NO: 738791 - protein, 253 aa, Homo sapiens [sequence omitted]

SEQ ID NO: 738792 - protein, 253 aa, Homo sapiens [sequence omitted]

SEQ ID NO: 738793 - protein, 216 aa, Homo sapiens
MSMEDPFFVVKGEVQKAVNTAQGLFQRWTELLQDPSTATREEIDWTTNELRNNLRSIEWDLEDLDETISIVEANPRKFNLDATELSIRKAFITSTRQVVRDMKDQMSTSSVQALAERKNRQALLGDSGSQNWSTGTTDKYGRLDRELQRANSHFIEEQQAQQQLIVEQQDEQLELVSGSIGVLKNMSQRIGGELEEQAVLASPKEAILLRKFYYRL

SEQ ID NO: 738794 - protein, 88 aa, Homo sapiens
GLEAAEGAGARVRDSASGAERVLDQRPSCAPGLCACPLLGFTQTKARAAAGTGGVGGGRPGGTGALCAEEVKAAGAGTPCPWRTPSLW

SEQ ID NO: 738795 - protein, 253 aa, Homo sapiens [sequence omitted]

SEQ ID NO: 738796 - protein, 253 aa, Homo sapiens [sequence omitted]

SEQ ID NO: 738797 - protein, 253 aa, Homo sapiens [sequence omitted]

SEQ ID NO: 738798 - protein, 236 aa, Homo sapiens
MSMEDPFFVVKGEVQKAVNTAQGLFQRWTELLQDPSTATREEIDWTTNELRNNLRSIEWDLEDLDETISIVEANPRKFNLDATELSIRKAFITSTRQVVRDMKDQMSTSSVQALAERKNRQALLGDSGSQNWSTGTTDKYGRLDRELQRANSHFIEEQQAQQQLIVEQQDEQLELVSGSIGVLKNMSQRIGGELEEQAVMLEDFSHELESTQSRLDNVMKKLAKVSHMTSVTSCSF

SEQ ID NO: 738799 - protein, 138 aa, Homo sapiens
MSMEDPFFVVKGEVQKAVNTAQGLFQRWTELLQDPSTATREEIDWTTNELRNNLRSIEWDLEDLDETISIVEANPRKFNLDATELSIRKAFITSTRQVVRDMKDQMSTSSVQALAERKNRQALFGLWALFGLWALFGL

SEQ ID NO: 738800 - protein, 103 aa, Homo sapiens
QTQYPMCSIPAKKLPLEPNCTKRIRKPKLRDTLKLKDRKKRIQCVILDQILHRGEKKKWLQRTLLEQWEKCESLFPMLNFLNLITLLWLCTRMSLCPRETRST

SEQ ID NO: 738801 - protein, 106 aa, Homo sapiens
RLGTRPGGEQAMQRGLGRSEVSPGEAIYDVIGEMPPAGLYEEIMEAEAVLQDEEDGSVVKVDTEAAVSGEVSNLLEGQSIRAEGGHSRPVSQGYDEAAFPLEEMTL

SEQ ID NO: 738802 - protein, 118 aa, Homo sapiens
AHWEASCGLLARDGGQGWEGTGSLAMLPWSLHPSPQHPASLLPGWGSCLELLSSLACGHIHTEGLCVTMLTLPQVWEDPRYLLEKPSMMSLGKCRQQDCTRKSWRPRLCSKMRRTEVW

SEQ ID NO: 738803 - protein, 713 aa, Homo sapiens
MEPGTGGSRKRLGPRAGFRFWPPFFPRRSQAGSSKFPTPLGPENSGNPTLLSSAQPETRVSYWTKLLSQLLAPLPGLLQKVLIWSQLFGGMFPTRWLDFAGVYSALRALKGREKPAAPTAQKSLSSLQLDSSDPSVTSPLDWLEEGIHWQYSPPDLKLELKAKGSALDPAAQAFLLEQQLWGVELLPSSLQSRLYSNRELGSSPSGPLNIQRIDNFSVVSYLLNPSYLDCFPRLEVSYQNSDGNSEVVGFQTLTPESSCLREDHCHPQPLSAELIPASWQGCPPLSTEGLPEIHHLRMKRLEFLQQASKGQDLPTPDQDNGYHSLEEEHSLLRMDPKHCRDNPTQFVPAAGDIPGNTQESTEEKIELLTTEVPLALEEESPSEGCPSSEIPMEKEPGEGRISVVDYSYLEGDLPISARPACSNKLIDYILGGASSDLETSSDPEGEDWDEEAEDDGFDSDSSLSDSDLEQDPEGLHLWNSFCSVDPYNPQNFTATIQTAARIVPEEPSDSEKDLSGKSDLENSSQSGSLPETPEHSSGEEDDWESSADEAESLKLWNSFCNSDDPYNPLNFKAPFQTSGENEKGCRDSKTPSESIVAISECHTLLSCKVQLLGSQESECPDSVQRDVLSGGRHTHVKRKKVTFLEEVTEYYISGDEDRKGPWEEFARDGCRFQKRIQETEDAIGYCLTFEHRERMFNRLQGTCFKGLNVLKQC

SEQ ID NO: 738804 - protein, 713 aa, Homo sapiens; identical to SEQ ID NO: 738803

SEQ ID NO: 738805 - protein, 713 aa, Homo sapiens; identical to SEQ ID NO: 738803

SEQ ID NO: 738806 - protein, 713 aa, Homo sapiens; identical to SEQ ID NO: 738803

SEQ ID NO: 738807 - protein, 713 aa, Homo sapiens; identical to SEQ ID NO: 738803

SEQ ID NO: 738808 - protein, 713 aa, Homo sapiens; identical to SEQ ID NO: 738803

SEQ ID NO: 738809 - protein, 713 aa, Homo sapiens; identical to SEQ ID NO: 738803

SEQ ID NO: 738810 - protein, 695 aa, Homo sapiens
MEPGTGGSRKRLGPRAGFRFWPPFFPRRSQAGSSKFPTPLGPENSGNPTLLSSAQPETRVSYWTKLLSQLLAPLPGLLQKVLIWSQLFGGMFPTRWLDFAGVYSALRALKGREKPAAPTAQKSLSSLQLDSSDPSVTSPLDWLEEGIHWQYSPPDLKLELKAKGSALDPAAQAFLLEQQLWGVELLPSSLQSRLYSNRELGSSPSGPLNIQRIDNFSVVSYLLNPSYLDCFPRLEVSYQNSDGNSEVVGFQTLTPESSCLREDHCHPQPLSAELIPASWQGCPPLSTEGLPEIHHLRMKRLEFLQQASKGQDLPTPDQDNGYHSLEEEHSLLRMDPKHCRDNPTQFVPAAGDIPGNTQESTEEKIELLTTEVPLALEEESPSEGCPSSEIPMGDLPISARPACSNKLIDYILGGASSDLETSSDPEGEDWDEEAEDDGFDSDSSLSDSDLEQDPEGLHLWNSFCSVDPYNPQNFTATIQTAARIVPEEPSDSEKDLSGKSDLENSSQSGSLPETPEHSSGEEDDWESSADEAESLKLWNSFCNSDDPYNPLNFKAPFQTSGENEKGCRDSKTPSESIVAISECHTLLSCKVQLLGSQESECPDSVQRDVLSGGRHTHVKRKKVTFLEEVTEYYISGDEDRKGPWEEFARDGCRFQKRIQETEDAIGYCLTFEHRERMFNRLQGTCFKGLNVLKQC

SEQ ID NO: 738811 - protein, 695 aa, Homo sapiens
MEPGTGGSRKRLGPRAGFRFWPPFFPRRSQAGSSKFPTPLGPENSGNPTLLSSAQPETRVSYWTKLLSQLLAPLPGLLQKVLIWSQLFGGMFPTRWLDFAGVYSALRALKGREKPAAPTAQKSLSSLQLDSSDPSVTSPLDWLEEGIHWQYSPPDFLLEQQLWGVELLPSSLQSRLYSNRELGSSPSGPLNIQRIDNFSVVSYLLNPSYLDCFPRLEVSYQNSDGNSEVVGFQTLTPESSCLREDHCHPQPLSAELIPASWQGCPPLSTEGLPEIHHLRMKRLEFLQQASKGQDLPTPDQDNGYHSLEEEHSLLRMDPKHCRDNPTQFVPAAGDIPGNTQESTEEKIELLTTEVPLALEEESPSEGCPSSEIPMEKEPGEGRISVVDYSYLEGDLPISARPACSNKLIDYILGGASSDLETSSDPEGEDWDEEAEDDGFDSDSSLSDSDLEQDPEGLHLWNSFCSVDPYNPQNFTATIQTAARIVPEEPSDSEKDLSGKSDLENSSQSGSLPETPEHSSGEEDDWESSADEAESLKLWNSFCNSDDPYNPLNFKAPFQTSGENEKGCRDSKTPSESIVAISECHTLLSCKVQLLGSQESECPDSVQRDVLSGGRHTHVKRKKVTFLEEVTEYYISGDEDRKGPWEEFARDGCRFQKRIQETEDAIGYCLTFEHRERMFNRLQGTCFKGLNVLKQC

SEQ ID NO: 738812 - protein, 713 aa, Homo sapiens; identical to SEQ ID NO: 738803

SEQ ID NO: 738813 - protein, 577 aa, Homo sapiens
KQTPRSGEGQSEVIWHPAILEELVLLHGPCSRGHPTDRASTLSLWGVELLPSSLQSRLYSNRELGSSPSGPLNIQRIDNFSVVSYLLNPSYLDCFPRLEVSYQNSDGNSEVVGFQTLTPESSCLREDHCHPQPLSAELIPASWQGCPPLSTEGLPEIHHLRMKRLEFLQQASKGQDLPTPDQDNGYHSLEEEHSLLRMDPKHCRDNPTQFVPAAGDIPGNTQESTEEKIELLTTEVPLALEEESPSEGCPSSEIPMEKEPGEGRISVVDYSYLEGDLPISARPACSNKLIDYILGGASSDLETSSDPEGEDWDEEAEDDGFDSDSSLSDSDLEQDPEGLHLWNSFCSVDPYNPQNFTATIQTAARIVPEEPSDSEKDLSGKSDLENSSQSGSLPETPEHSSGEEDDWESSADEAESLKLWNSFCNSDDPYNPLNFKAPFQTSGENEKGCRDSKTPSESIVAISECHTLLSCKVQLLGSQESECPDSVQRDVLSGGRHTHVKRKKVTFLEEVTEYYISGDEDRKGPWEEFARDGCRFQKRIQETEDAIGYCLTFEHRERMFNRLQGTCFKGLNVLKQC

SEQ ID NO: 738814 - protein, 69 aa, Homo sapiens
LLLRSTLRIPSRDRKGPWEEFARDGCRFQKRIQETEDAIGYCLTFEHRERMFNRLQGTCFKGLNVLKQC

SEQ ID NO: 738815 - protein, 713 aa, Homo sapiens; identical to SEQ ID NO: 738803

SEQ ID NO: 738816 - protein, 444 aa, Homo sapiens
MEPGTGGSRKRLGPRAGFRFWPPFFPRRSQAGSSKFPTPLGPENSGNPTLLSSAQPETRVSYWTKLLSQLLAPLPGLLQKVLIWSQLFGGMFPTRWLDFAGVYSALRALKGREKPAAPTAQKSLSSLQLDSSDPSVTSPLDWLEEGIHWQYSPPDLKLELKAKGSALDPAAQAFLLEQQLWGVELLPSSLQSRLYSNRELGSSPSGPLNIQRIDNFSVVSYLLNPSYLDCFPRLEVSYQNSDGNSEVVGFQTLTPESSCLREDHCHPQPLSAELIPASWQGCPPLSTEGLPEIHHLRMKRLEFLQQASKGQDLPTPDQDNGYHSLEEEHSLLRMDPKHCRDNPTQFVPAAGDIPGNTQESTEEKIELLTTEVPLALEEESPSEGCPSSEIPMEKEPGEGRISVVDYSYLEGDLPISARPACSNKLIDYILGRKITSVPPLATAG

SEQ ID NO: 738817 - protein, 551 aa, Homo sapiens
MEEAELVKGRLQAITDKRKIQEEISQKRLKIEEDKLKHQHLKKKALREKWLLDGISSGKEQEEMKKQNQQDQHQIQVLEQSILRLEKEIQDLEKAELQISTKEEAILKKLKSIERTTEDIIRSVKVEREERAEESIEDIYANIPDLPKSYIPSRLRKEINEEKEDDEQNRKALYAMEIKVEKDLKTGESTVLSSIPLPSDDFKGTGIKVYDDGQKSVYAVSSNHSAAYNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 738818 - protein, 551 aa, Homo sapiens; identical to SEQ ID NO: 738817

SEQ ID NO: 738819 - protein, 520 aa, Homo sapiens
MEEAELVKGRLQAITDKRKIQEEISQKRLKIEEDKLKHQHLKKKALREKWLLDGISSGKEQEEMKKQNQQKEEAILKKLKSIERTTEDIIRSVKVEREERAEESIEDIYANIPDLPKSYIPSRLRKEINEEKEDDEQNRKALYAMEIKVEKDLKTGESTVLSSIPLPSDDFKGTGIKVYDDGQKSVYAVSSNHSAAYNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 738820 - protein, 551 aa, Homo sapiens; identical to SEQ ID NO: 738817

SEQ ID NO: 738821 - protein, 376 aa, Homo sapiens
MEIKVEKDLKTGESTVLSSIPLPSDDFKGTGIKVYDDGQKSVYAVSSNHSAAYNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 738822 - protein, 488 aa, Homo sapiens
MKKQNQQDQHQIQVLEQSILRLEKEIQDLEKAELQISTKEEAILKKLKSIERTTEDIIRSVKVEREERAEESIEDIYANIPDLPKSYIPSRLRKEINEEKEDDEQNRKALYAMEIKVEKDLKTGESTVLSSIPLPSDDFKGTGIKVYDDGQKSVYAVSSNHSAAYNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 738823 - protein, 281 aa, Homo sapiens
PFDAQTTGDGTEDPSLTALRMRMAKLGKKVIKSCTTYINIFERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 738824 - protein, 263 aa, Homo sapiens
IKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTGNKNDKACHCCSVM

SEQ ID NO: 738825 - protein, 476 aa, Homo sapiens
WEPMGTLGGAGLAAAVAAGWARTLGMEGERRASQAPSSGLPAGGANGESPGGGAPFPGSSGSSALLQAEVLDLDEDEDDLEVFSKDASLMDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFIETRRKALHKFLNRIADHPTLTFNEDFKIFLTAQAWELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMKRRDQIQAELDSKVEVLTYKKADTDLLPEEIGKLEDKVECANNALKADWERWKQNMQNDIKLAFTDMAEENIHYYEQCLATWESFLTSQTNLHLEEASEDKP

SEQ ID NO: 738826 - protein, 476 aa, Homo sapiens; identical to SEQ ID NO: 738825

SEQ ID NO: 738827 - protein, 476 aa, Homo sapiens; identical to SEQ ID NO: 738825

SEQ ID NO: 738828 - protein, 476 aa, Homo sapiens; identical to SEQ ID NO: 738825

SEQ ID NO: 738829 - protein, 125 aa, Homo sapiens
SQKRYEEIVKDVASCIDRCCKATEKRMSGLSEALLPVVHEYVLYSEMLMLPEEIGKLEDKVECANNALKADWERWKQNMQNDIKLAFTDMAEENIHYYEQCLATWESFLTSQTNLHLEEASEDKP

SEQ ID NO: 738830 - protein, 67 aa, Homo sapiens
VSVSSRSFFGKTLIALLRGNHSLHHRPTFTWKKPLKINLNPIEDFCLIFGRQHLLTKVILSGSAVSL

SEQ ID NO: 738831 - protein, 476 aa, Homo sapiens; identical to SEQ ID NO: 738825

SEQ ID NO: 738832 - protein, 476 aa, Homo sapiens; identical to SEQ ID NO: 738825

SEQ ID NO: 738833 - protein, 425 aa, Homo sapiens
WEPMGTLGGAGLAAAVAAGWARTLGMEGERRASQAPSSGLPAGGANGESPGGGAPFPGSSGSSALLQAEVLDLDEDEDDLEVFSKDASLMDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFIETRRKALHKFLNRIADHPTLTFNEDFKIFLTAQAWELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMKRRDQIQAELDSKVEVLTYKKADTDLCLATWESFLTSQTNLHLEEASEDKP

SEQ ID NO: 738834 - protein, 471 aa, Homo sapiens
WEPMGTLGGAGLAAAVAAGWARTLGMEGERRASQAPSSGLPAGGANGESPGGGAPFPGSSGSSALLQAEVLDLDEDEDDLEVFSKDASLMDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFIETRRKALHKFLNRIADHPTLTFNEDFKIFLTAQAWELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMKRRDQIQAELDSKVEVLTYKKADTDLLPEEIGKLEDKVECANNALKADWERWKQNMQNDIKLAFTDMAEENIHYYEQCLATWESFLTSQYLQTGYRL

SEQ ID NO: 738835 - protein, 100 aa, Homo sapiens
RRPMEGALAPMACVLSRGPRWGREGWRAWATSIHTSHLSPPLQLPALPFHSLPRDLVVTALGSAQIQDCSGQGAGATAELGGTEAHSWERSRGGKVTTIY

SEQ ID NO: 738836 - protein, 142 aa, Homo sapiens
VVKQFRDGGYNTLVSTCVGEEGLDIGEVDLIICFDSQKSPIRLVQRMGRTGRKRQGRIVIILSEGREERIYNQSQSNKRSIYKAISSNRQVLHFYQRSPRMVPDGINPKLHKMFITHGVYEPEKPSRNLQRKSSIFSYRDGK

SEQ ID NO: 738837 - protein, 104 aa, Homo sapiens
RLLRGCSAGSVHCCGLCTSRVGVFVQGPAERGFLSLIGLPSAIRVKQEFQPSQSYRYGNWYARQHGSYLLSGYSYGCAVDGNGKDCFSAHETPEHTAGTLVMPK

SEQ ID NO: 738838 - protein, 166 aa, Homo sapiens
RLLRGCSAGSVHCCGLCTSRVGVFVQGPAERGFLSLIGLPSAIRVKQEFQPSQSYRYGNWYARQHGSYLLSGYSYGCAVDGNGKDCFSAHETPEHTAGTLVMPKETTPLAENQDEDPLEDPHLHLNIEESNQEFMVKSEELYDSLMNCHWQPLDTVHSEIPDETPK

SEQ ID NO: 738839 - protein, 160 aa, Homo sapiens
RLLRGCSAGSVHCCGLCTSRVGVFVQGPAERGFLSLIGVKQEFQPSQSYRYGNWYARQHGSYLLSGYSYGCAVDGNGKDCFSAHETPEHTAGTLVMPKETTPLAENQDEDPLEDPHLHLNIEESNQEFMVKSEELYDSLMNCHWQPLDTVHSEIPDETPK

SEQ ID NO: 738840 - protein, 130 aa, Homo sapiens
RLLRGCSAGSVHCCGLCTSRVGVFVQGPAERGFLSLIGYGCAVDGNGKDCFSAHETPEHTAGTLVMPKETTPLAENQDEDPLEDPHLHLNIEESNQEFMVKSEELYDSLMNCHWQPLDTVHSEIPDETPK

SEQ ID NO: 738841 - protein, 78 aa, Homo sapiens
AAGSLSCAARANNLSFSHQPLAVTTHETHYEDPHLHLNIEESNQEFMVKSEELYDSLMNCHWQPLDTVHSEIPDETPK

SEQ ID NO: 738842 - protein, 104 aa, Homo sapiens; identical to SEQ ID NO: 738837

SEQ ID NO: 738843 - protein, 152 aa, Homo sapiens
MAQPESSADFGIAQQNNYYCYWQSLPSAIRVKQEFQPSQSYRYGNWYARQHGSYLLSGYSYGCAVDGNGKDCFSAHETPEHTAGTLVMPKETTPLAENQDEDPLEDPHLHLNIEESNQEFMVKSEELYDSLMNCHWQPLDTVHSEIPDETPK

SEQ ID NO: 738844 - protein, 196 aa, Homo sapiens
RLLRGCSAGSVHCCGLCTSRVGVFVQGPAERGFLSLIGLPSAIRVKQEFQPSQSYRYGNWYARQHGSYLLSGYSYGCAVDGNGKDCFSAHETPEHTAGTLVMPKETTPLAENQDEDPLEVTSQYVAQADLKLPDLSNSLVSASQSVGVTDPHLHLNIEESNQEFMVKSEELYDSLMNCHWQPLDTVHSEIPDETPK

SEQ ID NO: 738845 - protein, 111 aa, Homo sapiens
MAKIILRKTRAAQSPPVDSAAETPPREGKSHFQILLDVVQFLPEDIIIQTFEGWLLIKAQHGTRMDEHGFISRSFTRQYKLPDGVEIKDLSAVLCHDGILVVEVKDPVGTK

SEQ ID NO: 738846 - protein, 150 aa, Homo sapiens
MAKIILRHLIEIPVRYQEEFEARGLEDCRLDHALYALPGPTIVDLRKTRAAQSPPVDSAAETPPREGKSHFQILLDVVQFLPEDIIIQTFEGWLLIKAQHGTRMDEHGFISRSFTRQYKLPDGVEIKDLSAVLCHDGILVVEVKDPVGTK

SEQ ID NO: 738847 - protein, 101 aa, Homo sapiens
TSRYLHIGNSGFNILILGSNRGKKPFPIHSYTSLLTPDIGICLKPANSPSFQTPPGGPTIKLWHYLTQSHKTAPHFRCQLQGVGPNLATNWGFPQPSPLVC

SEQ ID NO: 738848 - protein, 121 aa, Homo sapiens
MQGSGKFAHPTNREEWWPPLMNGVGGGPCHNRGPDGNKGDKSVRLVECLLCLCLGSKRGSFKFGPYFQDIVILPSSKTWPNKCLLFMSQITSFFFIGGVSRRVRLAGCDVSNLGERARLHL

SEQ ID NO: 738849 - protein, 340 aa, Homo sapiens
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGVYK

SEQ ID NO: 738850 - protein, 340 aa, Homo sapiens; identical to SEQ ID NO: 738849

SEQ ID NO: 738851 - protein, 346 aa, Homo sapiens
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGGCCMSLKHQ

SEQ ID NO: 738852 - protein, 173 aa, Homo sapiens
MALAPTPKDQGSLSGLVYSFCPAPASCQAPLPTVGLPHPCTGSNLPALMPASPPASWPPIPALLETSLHSGNLPEHLPNSALSASLHLSWPPCTSSSPPNSLDLHPGRLLPTFIVLASLNPQSSLPSLLYHLPFPLHVPPPSSSCLLISLKHPLLQPPVTVYSAKLTALRRGL

SEQ ID NO: 738853 - protein, 244 aa, Homo sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVVAAILV

SEQ ID NO: 738854 - protein, 174 aa, Homo sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGFPENTLLTGRTTCM

SEQ ID NO: 738855 - protein, 151 aa, Homo sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQSFWVISSRKTESLCKYRMASLQIWTRSATSCYRVEQWAYQNMGCIYRNLLLTWESY

SEQ ID NO: 738856 - protein, 107 aa, Homo sapiens [sequence omitted]

SEQ ID NO: 738857 - protein, 244 aa, Homo sapiens; identical to SEQ ID NO: 738853

SEQ ID NO: 738858 - protein, 244 aa, Homo sapiens; identical to SEQ ID NO: 738853

SEQ ID NO: 738859 - protein, 244 aa, Homo sapiens; identical to SEQ ID NO: 738853

SEQ ID NO: 738860 - protein, 244 aa, Homo sapiens; identical to SEQ ID NO: 738853

SEQ ID NO: 738861 - protein, 251 aa, Homo sapiens
MASFPPRVNEKEIVFLFFLLVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVVAAILV

SEQ ID NO: 738862 - protein, 107 aa, Homo sapiens
GRLLLLNSRPHRRRIKIWDVYTGKLLLNLVDHTEVVRDLTFAPDGSLILVSASRDKTLRVWDLKDDGNMMKVLRGHQNWVYSCAFSPDSSMLCSVGASKAVVAAILV

SEQ ID NO: 738863 - protein, 244 aa, Homo sapiens; identical to SEQ ID NO: 738853

SEQ ID NO: 738864 - protein, 163 aa, Homo sapiens
LNDRARYPSITLLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 738865 - protein, 173 aa, Homo sapiens
MASFPPRVNEKEIVFLFFLLVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTEVWIHSF

SEQ ID NO: 738866 - protein, 110 aa, Homo sapiens
MASFPPRVNEKEIVRLRTIGELLAPAAPFDKKCGRENWTVAFAPDGSYFAWSQGHRTVKLVPWSQCLQNFLLHGTKNVTWSQCLQNFLLHGTITILFGNLKLLELVTFLV

SEQ ID NO: 738867 - protein, 421 aa, Homo sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 738868 - protein, 244 aa, Homo sapiens; identical to SEQ ID NO: 738853

SEQ ID NO: 738869 - protein, 244 aa, Homo sapiens; identical to SEQ ID NO: 738853

SEQ ID NO: 738870 - protein, 244 aa, Homo sapiens; identical to SEQ ID NO: 738853

SEQ ID NO: 738871 - protein, 421 aa, Homo sapiens; identical to SEQ ID NO: 738867

SEQ ID NO: 738872 - protein, 244 aa, Homo sapiens; identical to SEQ ID NO: 738853

SEQ ID NO: 738873 - protein, 275 aa, Homo sapiens
MASFPPRVNEKEIGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 738874 - protein, 166 aa, Homo sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTEVWIHSF

SEQ ID NO: 738875 - protein, 365 aa, Homo sapiens
SRVSWCWRQALGGLARTWQGLFTMADDLEQQSQGWLSSWLPTWRPTSMSQLKNVEARILQCLQNKFLARYVSLPNQNKIWTVTVSPEQNDRTPLVMVHGFGGGVGLWILNMDSLSARRTLHTFDLLGFGRSSRPAFPRDPEGAEDEFVTSIETWRETMGIPSMILLGHSLGGFLATSYSIKYPDRVKHLILVDPWGFPLRPTNPSEIRAPPAWVKAVASVLGRSNPLAVLRVAGPWGPGLVQRFRPDFKRKFADFFEDDTISEYIYHCNAQNPSGETAFKAMMESFGWARRPMLERIHLIRKDVPITMIYGSDTWIDTSTGKKVKMQRPDSYVRDMEIKGASHHVYADQPHIFNAVVEEICDSVD

SEQ ID NO: 738876 - protein, 330 aa, Homo sapiens
QAGTAPAYWISSTTPSLEQQSQGWLSSWLPTWRPTSMSQLKNVEARILQCLQNKFLARYVSLPNQNKIWTVTVSPEQNDRTPLVMVHGFGGGVGLWILNMDSLSARRTLHTFDLLGFGRSSRPAFPRDPEGAEDEFVTSIETWRETMGIPSMILLGHSLGGFLATSYSIKYPDRVKHLILVDPWGFPLRPTNPSEIRAPPAWVKAVASVLGRSNPLAVLRVAGPWGPGLVQRFRPDFKRKFADFFEDDTISEYIYHCNAQNPSGETASKHDGSLVAGPMWRNSWIGRWAYTDYGATLLNLGNREGAHTSQGTGAPASAPTNGAPPPPQTT

SEQ ID NO: 738877 - protein, 365 aa, Homo sapiens; identical to SEQ ID NO: 738875

SEQ ID NO: 738878 - protein, 365 aa, Homo sapiens; identical to SEQ ID NO: 738875

SEQ ID NO: 738879 - protein, 238 aa, Homo sapiens
SRVSWCWRQALGGLARTWQGLFTMADDLEQQSQGWLSSWLPTWRPTSMSQLKNVEARILQCLQNKFLARYVSLPNQNKIWTVTVSPEQNDRTPLVMVHGFGGGVGLWILNMDSLSARRTLHTFDLLGFGRSSRPAFPRDPEGAEDEFVTSIETWRETMGIPSMILLGHSLGGFLATSYSIKYPDRVKHLILVDPWGFPLRPTNPSEIRAPPAWVKAVASVLGRSNPLAVLRVAGPWGE

SEQ ID NO: 738880 - protein, 103 aa, Homo sapiens
LAHAAPPTHSPSHLLNCPGAVRATSLIPFCCCSFLETESHSVTQAGVQWHHLGSLQPLPARFKRFSCLSFLCSWDYRRTPPGPANFCIFSRDGVSPCRPGCSR

SEQ ID NO: 738881 - protein, 109 aa, Homo sapiens [sequence omitted]

SEQ ID NO: 738882 - protein, 2564 aa, Homo sapiens
ACLCCACLLELIPYAPTLSWTACPPAMAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEDCGCVHGLCDNRPGSGGVCQQGTCAPGFSGRFCNESMGDCGPTGLAQHCHLHARCVSQEGVARCRCLDGFEGDGFSCTPSNPCSHPDRGGCSENAECVPGSLGTHHCTCHKGWSGDGRVCVAIDECELDVRGGCHTDALCSYVGPGQSRCTCKLGFAGDGYQCSPIDPCRAGNGGCHGLELEANAHFSIFYQWLKSAGITLPADRRVTALVPSEAAVRQLSPEDRAFWLQPRTLPNLVRAHFLQGALFEEELARLGGQEVATLNPTTRWEIRNISGRVWVQNASVDVADLLATNGVLHILSQVLLPPRGDVPGGQGLLQQLDLVPAFSLFRELLQHHGLVPQIEAATAYTIFVPTNRSLEAQGNSSHLDADTVRHHVVLGEALSMETLRKGGHRNSLLGPAHWIVFYNHSGQPEVNHVPLEGPMLEAPGRSLIGLSGVLTVGSSRCLHSHAEALREKCVNCTRRFRCTQGFQLQDTPRKSCVYRSGFSFSRGCSYTCAKKIQVPDCCPGFFGTLCEPCPGGLGGVCSGHGQCQDRFLGSGECHCHEGFHGTACEVCELGRYGPNCTGVCDCAHGLCQEGLQGDGSCVCNVGWQGLRCDQKITSPQCPRKCDPNANCVQDSAGASTCACAAGYSGNGIFCSEVDPCAHGHGGCSPHANCTKVAPGQRTCTCQDGYMGDGELCQEINSCLIHHGGCHIHAECIPTGPQQVSCSCREGYSGDGIRTCELLDPCSKNNGGCSPYATCKSTGDGQRTCTCDTAHTVGDGLTCRARVGLELLRDKHASFFSLRLLEYKELKGDGPFTIFVPHADLMSNLSQDELARIRAHRQLVFRYHVVGCRRLRSEDLLEQGYATALSGHPLRFSEREGSIYLNDFARVVSSDHEAVNGILHFIDRVLLPPEALHWEPDDAPIPRRNVTAAAQGFGYKIFSGLLKVAGLLPLLREASHRPFTMLWPTDAAFRALPPDRQAWLYHEDHRDKLAAILRGHMIRNVEALASDLPNLGPLRTMHGTPISFSCSRTRPGELMVGEDDARIVQRHLPFEGGLAYGIDQLLEPPGLGARCDHFETRPLRLNTCSICGLEPPCPEGSQEQGSPEACWRFYPKFWTSPPLHSLGLRSVWVHPSLWGRPQGLGRGCHRNCVTTTWKPSCCPGHYGSECQACPGGPSSPCSDRGVCMDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAMCTDQHFQEKRAGVFHLQATSGPYGLNFSEAEAACEAQGAVLASFPQLSAAQQLGFHLCLMGWLANGSTAHPVVFPVADCGNGRVGVVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAAGVGAVLAAGALLGLVAGALYLRARGKPTGFGFSAFQAEDDADDDFSPWQEGTNPTLVSVPNPVFGSDTFCEPFDDSLLEEDFPDTQRILTVK

SEQ ID NO: 738883 - protein, 863 aa, Homo sapiens
ACLCCACLLELIPYAPTLSWTACPPAMAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICKEPTLEIPHFGSMRGKERELIVLRSENGETWKEHQFDSKNEDLTTLLNGMDEELDSPEELGSVSART

SEQ ID NO: 738884 - protein, 2596 aa, Homo sapiens
ACLCCACLLELIPYAPTLSWTACPPAMAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEDCGCVHGLCDNRPGSGGVCQQGTCAPGFSGRFCNESMGDCGPTGLAQHCHLHARCVSQEGVARCRCLDGFEGDGFSCTPSNPCSHPDRGGCSENAECVPGSLGTHHCTCHKGWSGDGRVCVAIDECELDVRGGCHTDALCSYVGPGQSRCTCKLGFAGDGYQCSPIDPCRAGNGGCHGLATCRAVGGGQRVCTCPPGFGGDGFSCYGDIFRELEANAHFSIFYQWLKSAGITLPADRRVTALVPSEAAVRQLSPEDRAFWLQPRTLPNLVRAHFLQGALFEEELARLGGQEVATLNPTTRWEIRNISGRVWVQNASVDVADLLATNGVLHILSQVLLPPRGDVPGGQGLLQQLDLVPAFSLFRELLQHHGLVPQIEAATAYTIFVPTNRSLEAQGNSSHLDADTVRHHVVLGEALSMETLRKGGHRNSLLGPAHWIVFYNHSGQPEVNHVPLEGPMLEAPGRSLIGLSGVLTVGSSRCLHSHAEALREKCVNCTRRFRCTQGFQLQDTPRKSCVYRSGFSFSRGCSYTCAKKIQVPDCCPGFFGTLCEPCPGGLGGVCSGHGQCQDRFLGSGECHCHEGFHGTACEVCELGRYGPNCTGVCDCAHGLCQEGLQGDGSCVCNVGWQGLRCDQKITSPQCPRKCDPNANCVQDSAGASTCACAAGYSGNGIFCSEVDPCAHGHGGCSPHANCTKVAPGQRTCTCQDGYMGDGELCQEINSCLIHHGGCHIHAECIPTGPQQVSCSCREGYSGDGIRTCELLDPCSKNNGGCSPYATCKSTGDGQRTCTCDTAHTVGDGLTCRARVGLELLRDKHASFFSLRLLEYKELKGDGPFTIFVPHADLMSNLSQDELARIRAHRQLVFRYHVVGCRRLRSEDLLEQGYATALSGHPLRFSEREGSIYLNDFARVVSSDHEAVNGILHFIDRVLLPPEALHWEPDDAPIPRRNVTAAAQGFGYKIFSGLLKVAGLLPLLREASHRPFTMLWPTDAAFRALPPDRQAWLYHEDHRDKLAAILRGHMIRNVEALASDLPNLGPLRTMHGTPISFSCSRTRPGELMVGEDDARIVQRHLPFEGGLAYGIDQLLEPPGLGARCDHFETRPLRLNTCSICGLEPPCPEGSQEQGSPEACWRFYPKFWTSPPLHSLGLRSVWVHPSLWGRPQGLGRGCHRNCVTTTWKPSCCPGHYGSECQACPGGPSSPCSDRGVCMDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAMCTDQHFQEKRAGVFHLQATSGPYGLNFSEAEAACEAQGAVLASFPQLSAAQQLGFHLCLMGWLANGSTAHPVVFPVADCGNGRVGVVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAAGVGAVLAAGALLGLVAGALYLRARGKPTGFGFSAFQAEDDADDDFSPWQEGTNPTLVSVPNPVFGSDTFCEPFDDSLLEEDFPDTQRILTVK

SEQ ID NO: 738885 - protein, 860 aa, Homo sapiens
ACLCCACLLELIPYAPTLSWTACPPAMAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEGGWSWLRPPPREKKRLPKDGSGGSQEGKRSPRRRDEGQGEWRKICLKMGLGA

SEQ ID NO: 738886 - protein, 465 aa, Homo sapiens
PTYADAWALSRRRLGGDPGCQAPSCAQMDGTETRQRRLDSCGKPGELGLPHPLSTGGLPVASEDGALRAPESQSVTPKPLETEPSRETAWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 738887 - protein, 534 aa, Homo sapiens
PTYADAWALSRRRLGGDPGCQAPSCAQMDGTETRQRRLDSCGKPGELGLPHPLSTGGLPVASEDGALRAPESQSVTPKPLETEPSRETAWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFCLLAKTSI

SEQ ID NO: 738888 - protein, 547 aa, Homo sapiens
PPGPPAGLCAAGAWASAAVPERQVVRGPAARPGAGPGRPGLPASCLSRSRPCVLRPPLSRRRLGGDPGCQAPSCAQMDGTETRQRRLDSCGKPGELGLPHPLSTGGLPVASEDGALRAPESQSVTPKPLETEPSRETAWSIGLQVTVPFMFAGLGLSWAGMLLDYFQANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFCLLAKTSI

SEQ ID NO: 738889 - protein, 194 aa, Homo sapiens
KGKQIPFLLVGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFCLLAKTSI

SEQ ID NO: 738890 - protein, 514 aa, Homo sapiens
PTYADAWALSRRRLGGDPGCQAPSCAQMDGTETRQRRLDSCGKPGELGLPHPLSTGGLPVASEDGALRAPESQSVTPKPLETEPSRETAWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 738891 - protein, 487 aa, Homo sapiens
MDGTETRQRRLDSCGKPGELGLPHPLSTGGLPVASEDGALRAPESQSVTPKPLETEPSRETAWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 738892 - protein, 527 aa, Homo sapiens
PPGPPAGLCAAGAWASAAVPERQVVRGPAARPGAGPGRPGLPASCLSRSRPCVLRPPLSRRRLGGDPGCQAPSCAQMDGTETRQRRLDSCGKPGELGLPHPLSTGGLPVASEDGALRAPESQSVTPKPLETEPSRETAWSIGLQVTVPFMFAGLGLSWAGMLLDYFQANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 738893 - protein, 405 aa, Homo sapiens
GGLVMNSMQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 738894 - protein, 325 aa, Homo sapiens
LTRGSPLSEWVKEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 738895 - protein, 285 aa, Homo sapiens
MVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 738896 - protein, 514 aa, Homo sapiens; identical to SEQ ID NO: 738890

SEQ ID NO: 738897 - protein, 514 aa, Homo sapiens; identical to SEQ ID NO: 738890

SEQ ID NO: 738898 - protein, 514 aa, Homo sapiens; identical to SEQ ID NO: 738890

SEQ ID NO: 738899 - protein, 514 aa, Homo sapiens; identical to SEQ ID NO: 738890

SEQ ID NO: 738900 - protein, 514 aa, Homo sapiens; identical to SEQ ID NO: 738890

SEQ ID NO: 738901 - protein, 514 aa, Homo sapiens; identical to SEQ ID NO: 738890

SEQ ID NO: 738902 - protein, 1177 aa, Homo sapiens
GRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 738903 - protein, 1113 aa, Homo sapiens
AEGAPGPWAAGGCGGRGSMVVPEKEQSWIPKIFKKKTCTTFIVDSKIRGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 738904 - protein, 843 aa, Homo sapiens
MDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVGAWGTVPGSRDGGCRQRGMCNSALLTYPCAIPLNSLTSPFTPSPYSFPSLSHNNSSAPDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 738905 - protein, 171 aa, Homo sapiens
SSSVPGGSTEFETIVLKALVKGKSCTLQSSPSLSSTLDTFPGLGTSSTLSNPRPMPPLPLLIFFPFGALHGAIWAVFPDAFIMFQHLLSSVGSIHPFFHLSIHPHVQIDLSISLPTILPVIPHSEVGVLGTGCVTGSDRDNTEPPSETISMSVAFKAMQLEGPLRLSSEYN

SEQ ID NO: 738906 - protein, 1067 aa, Homo sapiens
AEGAPGPWAAGGCGGRGSMVVPEKEQSWIPKIFKKKTCTTFIVDSKIRGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKSSSVAASWGGWPRP

SEQ ID NO: 738907 - protein, 641 aa, Homo sapiens [sequence omitted]

SEQ ID NO: 738908 - protein, 297 aa, Homo sapiens
MINGSCLSYLCFPRADECLVKTLIESDEATAEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 738909 - protein, 233 aa, Homo sapiens
TRGWVWDSVRVLRVSEGAAGIGKGRGLSPLTPPAPAGVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKGQCVASACASPASVPVFLRVFLSRHLSSVPGSLSWSPLSLLYSRLRLSSFLPVSQFFCLSPSLPITCSLFSLFPQTEPCWRTSRRSPHRGFCS

SEQ ID NO: 738910 - protein, 432 aa, Homo sapiens
AEGAPGPWAAGGCGGRGSMVVPEKEQSWIPKIFKKKTCTTFIVDSKIRGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKGKSCTLQSSPSLSSTLDTFPGLGTSSTLSNPRPMPPLPLLIFFPFGALHGAIWAVFPDAFIMFQHLLSSVGSIHPFFHLSIHPHVQIDLSISLPTILPVIPHSEVGVLGTGCVTGSDRDNTEPPSETISMSVAFKAMQLEGPLRLSSEYN

SEQ ID NO: 738911 - protein, 143 aa, Homo sapiens
LTVYSSEDGSEEFETIVLKALVKGKSCTLQSSPSLSSTLDTFPGLGTSSTLSNPRPMPPLPLLIFFPFGALHGAIWAVFPDAFIMFQHLLSSVGSIHPFFHLSIHPHVQIDLSISLPTILPVIPHSFIHPSFHLSIHTSTDNS

SEQ ID NO: 738912 - protein, 140 aa, Homo sapiens
CWAYRLLGPGGEWPPPSLWTGPNRSWGWRRARDAELAIPQVERIMTRKELLTVYSSEDGSEEFETIVLKALVKGKSCTLQSSPSLSSTLDTFPGLGTSSTLSNPRPMPPLPLLIFFPFGALHGAIWAVFPDAFIMFQHLL

SEQ ID NO: 738913 - protein, 123 aa, Homo sapiens [sequence omitted]

SEQ ID NO: 738914 - protein, 84 aa, Homo sapiens
RGRERARRGVRGWRLSVCRLPGRQTLGGSPAGSDWAAGREGAPGHDGARKPSAAGTCTMDPKAGGGGEEDDCVDSGAETGGFSK

SEQ ID NO: 738915 - protein, 426 aa, Homo sapiens
MDPKAGGGGEEDDCVDSGAETGGSDYSHLSSTSSELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQDGPLSCLHLLATVNNSRYERGHKGCIRSFLNLAEYIMPPRRNVIPLLCRALLYQAIHLAAASSPRSTVLTRGPSGQACLLGTSRNLPDEPTAPPTLPGLSREASPCFVCPREAPPWPPQLNHSGFQTQVPQGTGHQSGGMATSSPSMT

SEQ ID NO: 738916 - protein, 90 aa, Homo sapiens
VSAHLEPFWCSSRLSASPAATSHLVVTSDTTPPPLKLSLACAPYLGHGISSYISRALRVVPVLHRELETLHPLHVAGCPDLDFMLAFPSK

SEQ ID NO: 738917 - protein, 156 aa, Homo sapiens
SWSKQMFQVFKPHAGEDYKYPRETETIWSHPYVVEGSHKSPLESLSLHGCLAAMAPSITSSEDSSPSQRDKKDLSLDLLLTRKKRSQGLHWSHWQGLNHMSIRIHTPEQGSPSLGQNWSWGNRKEKGVAQRQVPTTGTHSFFHCTSEGNKEKPHHF

SEQ ID NO: 738918 - protein, 103 aa, Homo sapiens
MAPSITSSEDSSPSQRDKKDLSLDLLLTRKKRSQGLHWSHWQGLNHMSIRIHTPEQGSPSLGQNWSWGNRKEKGVAQRQVPTTGTHSFFHCTSEGNKEKPHHF

SEQ ID NO: 738919 - protein, 139 aa, Homo sapiens
AAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEGGRTLTLEKNERGRAPEARG

SEQ ID NO: 738920 - protein, 361 aa, Homo sapiens
RLGEAGLNRQRLYQAPGSLALYSCPAYGASALAAPRSEELARSASGSAFSPYPGSAAFTAQAATGFGSPLQYSADAAAAAAGFPSYMGAPYDAHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDATRSKDESPDKAQEGTETSAEDEGISLHVDSLTDHSCSAESDGEKLPCRAGDPLCESGSECKDKYDDLEDDEDDDEEGERGLAPPKPVTSSPLTGLEAPLLSPPPEAAPRGGRKTPQGSRTSPGAPPPASKPKLWSLAEIATSDLKQPSLGPGCGPPGLPAA

SEQ ID NO: 738921 - protein, 286 aa, Homo sapiens
RLGEAGLNRQRLYQAPGSLALYSCPAYGASALAAPRSEELARSASGSAFSPYPGSAAFTAQAATGFGSPLQYSADAAAAAAGFPSYMGAPYDAHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDATRSKDECIRERVHVQAFAAEPESVSAWRTSAANVRKPHKCSRDCFIQTQQLSSMADKFLEHMCRWTLIPSHQSRNTGIICPWASFR

SEQ ID NO: 738922 - protein, 70 aa, Homo sapiens
TGSCWFQGAPYDAHTTGMTGAISYHPYGSAAYPYQLNDPAYRKNATRDATATLKAWLNEHRKNPYPTKGE

SEQ ID NO: 738923 - protein, 499 aa, Homo sapiens
MCELYSKRDTLGLRKKHIGPSCKVFFASDPIKIVRAQRQYMFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 738924 - protein, 499 aa, Homo sapiens; identical to SEQ ID NO: 738923

SEQ ID NO: 738925 - protein, 285 aa, Homo sapiens
MQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 738926 - protein, 493 aa, Homo sapiens
MCELYSKRDTLGLRKKHIGPSCKVFFASDPIKIVRAQRQYMFDENGEQYLDCINNVAHGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 738927 - protein, 481 aa, Homo sapiens
MCELYSKRDTLGLRKKHIGPSCKVFFASDPIKIVRAQRQYMFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 738928 - protein, 426 aa, Homo sapiens
MELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 738929 - protein, 96 aa, Homo sapiens
LPAGPQTRCPEHTVVAAGGLLGAGEEGRLFLGMEAVAQDPSPVETWVGGRRSGQQGSAEAHCSPARPAPRDDCEASIQSPRCSILKFKKKKKIVSW

SEQ ID NO: 738930 - protein, 73 aa, Homo sapiens
ASQLNNQSSNQLINQLANHQTSIHPFIYPQQLPKYLWSIHHGPRPVRATTKVENHSPWFKEQKTQPVKQDEHK

SEQ ID NO: 738931 - protein, 73 aa, Homo sapiens; identical to SEQ ID NO: 738930

SEQ ID NO: 738932 - protein, 145 aa, Homo sapiens [sequence omitted]

SEQ ID NO: 738933 - protein, 213 aa, Homo sapiens
YPQEGYPQGPYPQGGYPQGHIPRAPSPPTPMDSHRSSQDKTLTHPSWCREVLAAGFSRAARADLSWDPMAFFTGLWGPFTCVSRVLSHHCFSTTGSLSAIQKMTRVRVVDNSALGNSPYHRAPRCIHVYKKNGVGKVGDQILLAIKGQKKKALIVGHCMPGPRMTPRFDSNNVVLIEDNGNPVGTRIKTPIPTSLRKREGEYSKVLAIAQNFV

SEQ ID NO: 738934 - protein, 145 aa, Homo sapiens [sequence omitted]

SEQ ID NO: 738935 - protein, 89 aa, Homo sapiens
WAVPQGTVVHHWYPRHLLNRTQTPSGAETVMAQHSAYTGEGPQSPVKKAMGSQDRSALAARENPAAGPTSLRKREGEYSKVLAIAQNFV

SEQ ID NO: 738936 - protein, 198 aa, Homo sapiens
MQLACQEYTVKNKVDLLHGGYCVRRKTVHCSSLEILYVLLKNKDFIEDLSWDPMAFFTGLWGPFTCVSRVLSHHCFSTTGSLSAIQKMTRVRVVDNSALGNSPYHRAPRCIHVYKKNGVGKVGDQILLAIKGQKKKALIVGHCMPGPRMTPRFDSNNVVLIEDNGNPVGTRIKTPIPTSLRKREGEYSKVLAIAQNFV

SEQ ID NO: 738937 - protein, 145 aa, Homo sapiens [sequence omitted]

SEQ ID NO: 738938 - protein, 164 aa, Homo sapiens
SSFLCSRGGPLPGDLSWDPMAFFTGLWGPFTCVSRVLSHHCFSTTGSLSAIQKMTRVRVVDNSALGNSPYHRAPRCIHVYKKNGVGKVGDQILLAIKGQKKKALIVGHCMPGPRMTPRFDSNNVVLIEDNGNPVGTRIKTPIPTSLRKREGEYSKVLAIAQNFV

SEQ ID NO: 738939 - protein, 213 aa, Homo sapiens; identical to SEQ ID NO: 738933

SEQ ID NO: 738940 - protein, 204 aa, Homo sapiens
GSQNCSIHESCNQRPGLNSHKVLSNGQHLGILAFSRGAWLVGPAAGFSRAARADLSWDPMAFFTGLWGPFTCVSRVLSHHCFSTTGSLSAIQKMTRVRVVDNSALGNSPYHRAPRCIHVYKKNGVGKVGDQILLAIKGQKKKALIVGHCMPGPRMTPRFDSNNVVLIEDNGNPVGTRIKTPIPTSLRKREGEYSKVLAIAQNFV

SEQ ID NO: 738941 - protein, 145 aa, Homo sapiens [sequence omitted]

SEQ ID NO: 738942 - protein, 70 aa, Homo sapiens
VIQVRGDRFASWSSSLHGQETVWRGSLPSELEEGRAGTKEWNRQGIHWNHPEGECAPLAGQVWRVVTSPL

SEQ ID NO: 738943 - protein, 342 aa, Homo sapiens
MVQASGHRRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 738944 - protein, 341 aa, Homo sapiens
MGSGHCLRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 738945 - protein, 305 aa, Homo sapiens
SLLSVHGLGPLSQVHPWLQNGLLVRDSKDPGNTAEEDGARVPGRVHEHICHDGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 738946 - protein, 256 aa, Homo sapiens
MGSGHCLRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 738947 - protein, 207 aa, Homo sapiens
VALGAGLLAVGESWMGWATFTDQGEEGLEPSGPWKTSHTRAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 738948 - protein, 272 aa, Homo sapiens [sequence omitted]

SEQ ID NO: 738949 - protein, 507 aa, Homo sapiens
MPWLLSAPKLVPAVANVRGLSGCMLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKAETNMVWYDWMRPSHAQLHSDYMQPLTEAKAKSKNKVRGVQQLIQRLRLIKSPAEIERMQIAGKLTSQAFIETMFTSKAPVEEAFLYAKFEFECRARGADILAYPPVVAGGNRSNTLHYVKNNQLIKDGEMVLLDGGCESSCYVSDITRTWPVNGRFTAPQAELYEAVLEIQRDCLALCFPGTSLENIYSMMLTLIGQKLKDLGIMKNIKENNAFKAARKYCPHHVGHYLGMDVHDTPDMPRSLPLQPGMVITIEPGIYIPEDDKDAPEKFRGLGVRIEDDVVVTQDSPLILSADCPKEMNDIEQICSQAS

SEQ ID NO: 738950 - protein, 507 aa, Homo sapiens; identical to SEQ ID NO: 738949

SEQ ID NO: 738951 - protein, 278 aa, Homo sapiens
MPWLLSAPKLVPAVANVRGLSGCMLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKAETNMVWYDWMRPSHAQLHSDYMQPLTEAKAKSKNKVRGVQQLIQRLRLIKSPAEIERMQIAGKLTSQRQGFSVLSRLVSNS

SEQ ID NO: 738952 - protein, 151 aa, Homo sapiens
LARFPGDAALQAVAFPVVTLFLFPTRELGRNALAALSPQAGSRCSKRPRPLRLDSSPTVSSHGVPWRDPSWSQAIPGSADPSPGGASAPQPSVLRGFLLYRLLLERGGPSVFSTVEVFCEAEMTAERKVCHPPEGLSSKLLGLRSCGNYHT

SEQ ID NO: 738953 - protein, 211 aa, Homo sapiens
MPWLLSAPKLVPAVANVRGLSGCMLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKGNKWEQKSHYKPDWD

SEQ ID NO: 738954 - protein, 425 aa, Homo sapiens
MLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKAETNMVWYDWMRPSHAQLHSDYMQPLTEAKAKSKNKVRGVQQLIQRLRLIKSPAEIERMQIAGKLTSQDGEMVLLDGGCESSCYVSDITRTWPVNGRFTAPQAELYEAVLEIQRDCLALCFPGTSLENIYSMMLTLIGQKLKDLGIMKNIKENNAFKAARKYCPHHVGHYLGMDVHDTPDMPRSLPLQPGMVITIEPGIYIPEDDKDAPEKFRGLGVRIEDDVVVTQDSPLILSADCPKEMNDIEQICSQAS

SEQ ID NO: 738955 - protein, 425 aa, Homo sapiens; identical to SEQ ID NO: 738954

SEQ ID NO: 738956 - protein, 425 aa, Homo sapiens; identical to SEQ ID NO: 738954

SEQ ID NO: 738957 - protein, 307 aa, Homo sapiens [sequence omitted]

SEQ ID NO: 738958 - protein, 102 aa, Homo sapiens
LARFPGDAALQAVAFPVVTLFLFPTRELGRNALAALSPQAGSRCSKRPRPLRRHYVCMSTCARACMWRRCRRREREITNATAAYSTSGLVLLEGDEKIRKVR

SEQ ID NO: 738959 - protein, 105 aa, Homo sapiens
LLKRAWAGAALQKPFVIPCCCFSQFEFECRARGADILAYPPVVAGGNRSNTLHYVKNNQLIKVREMPSVLLPLGPDSLVENLLTSCPLTFSFHKLADILKVFYCL

SEQ ID NO: 738960 - protein, 223 aa, Homo sapiens
SPRRAPPSHLLPRAGRAPLPRACVPRAQGRASSPRPAGVPGDAPARQWLDEEEPQRARSHTVTTTASSFAENFFTSSSSFAYDREFLRTLPGFLIVAEIVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVTICYAGNTYFSFIAWRSRTIQ

SEQ ID NO: 738961 - protein, 142 aa, Homo sapiens
GGRGDELCEEGVFFVFDSVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVTICYAGNTYFSFIAWRSRTIQ

SEQ ID NO: 738962 - protein, 223 aa, Homo sapiens; identical to SEQ ID NO: 738960

SEQ ID NO: 738963 - protein, 120 aa, Homo sapiens
LRWSFALVAQDGVQWRDLGSPQPPPPGFKRFSCLSLPSSRDYRHAPPCLANFVLLVEMGFLHIGQAGLELLTSGDLPASASQSAGIIGMSHRTRLVLNFISEMRGLDFTNRKVHSSCKIG

SEQ ID NO: 738964 - protein, 185 aa, Homo sapiens
LLGSQKWGMQTDGQPRTWPKFPPKLQWSRRDPGARSFQLRAGGWSRPRGTSRKVTADPDPGGKRPARGGGATLGTRPLSTPAQLCAEPGTRGSPVPGSQPAAGTRNLAGAYTLRPRPGNQEEAARPGAEQPAPGNSFILRPRQQQGGSFVLLKPAPHPRLLPTPLRFPATSQTDRQGTQRKKEEE

SEQ ID NO: 738965 - protein, 105 aa, Homo sapiens
SAAVWTFCVEGSVGHGENLVFFPEPVSLLQHSNCHLFFPNPLVLSLFKLFFLSLSPQLLLCFFLPELPTLTSFAPPLDSSLLFLLAFFFCDLQLCPLLQPPFSFP

SEQ ID NO: 738966 - protein, 398 aa, Homo sapiens
HRIPLKAWVLKLGGAARAGRPGCAPAPRRAAWGTVPGPPGPAMARPQRTPARSPDSIVEVKSKFDAEFRRFALPRASVSGFQEFSRLLRAVHQIPGLDVLLGYTDAHGDLLPLTNDDSLHRALASGPPPLRLLVQKRGEEGYSGQPLWEADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 738967 - protein, 323 aa, Homo sapiens
RQGCTDLQRPATGLTGESGEEGLVHAQGTQASPSAVPALGLTSEVVGNSYSAPCKQPKSGSRSLISTSPLFCSKADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 738968 - protein, 155 aa, Homo sapiens
HRIPLKAWVLKLGGAARAGRPGCAPAPRRAAWGTVPGPPGPAMARPQRTPARSPDSIVEVKSKFDAEFRRFALPRASVSGFQEFSRLLRAVHQIPGLDVLLGYTDAHGDLLPLTNDDSLHRALASGPPPLRLLVQKREADSSGLAGASNANARTG

SEQ ID NO: 738969 - protein, 387 aa, Homo sapiens
HRIPLKAWVLKLGGAARAGRPGCAPAPRRAAWGTVPGPPGPAMARPQRTPARSPDSIVEVKSKFDAEFRRFALPRASVSGFQEFSRLLRAVHQIPGLDVLLGYTDAHGDLLPLTNDDSLHRALASGPPPLRLLVQKREADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 738970 - protein, 96 aa, Homo sapiens
FDAEFRRFALPRASVSGFQEFSRLLRAVHQIPGLDVLLGYTDAHGDLLPLTNDDSLHRALASGPPPLRLLVQKRGEEGYSGQPLWGKVSVGQVYKG

SEQ ID NO: 738971 - protein, 115 aa, Homo sapiens
LCELGLGKDSLDTTKAIKAKKSSPLSLSLSPRPTVSLFLSFPRSPSDGTAEAGLYCCHLGSLHSSLGEKAGLHLKKKRKKKKENPMESPQKAIKISEFSQVAGYKINTQKSTSCL

SEQ ID NO: 738972 - protein, 118 aa, Homo sapiens
MEKEEITIPHLFLMCMNASASNSEGFFSNQEKVDICHQVSTLLSFHFISSGLTERQHSGRVLQFYPLCRSAFSSRTLALACWHPQSVWMLPRGFLSPHLHSCSLFLDGWEVQLLETTS

SEQ ID NO: 738973 - protein, 124 aa, Homo sapiens
AIAHLYLFTPRTFQLPLIMPPPSYLPPLCWCTSPNSFLLHSSLYLTIFMSPTSCFHLFWARHRLSNWERPLFIKLGFFLISLPNVVSQYSSYSSLQGVAGPTWSFETGPQAGVFNLDSLACCDP

SEQ ID NO: 738974 - protein, 165 aa, Homo sapiens
MGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQIL

SEQ ID NO: 738975 - protein, 384 aa, Homo sapiens
MGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLTCILAILIPRLDLVISLVGSVSSSALALIIPPLLEAYKMGLCACRPMFQPQPTPGERISNALLPSCWDDTSSIATDE

SEQ ID NO: 738976 - protein, 155 aa, Homo sapiens [sequence omitted]

SEQ ID NO: 738977 - protein, 308 aa, Homo sapiens
MGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLT

SEQ ID NO: 738978 - protein, 115 aa, Homo sapiens
WGLAFTETLLLRSWPHTHTQHPNSPPAPLPFCLELAPLQEAPRSSPLRLSLWFLFLHPSAFYKKPTVMTLKQVQVPNLAPHFLAQEQESLPHTTGMEIKGSTHGPRPLPELELRS

SEQ ID NO: 738979 - protein, 757 aa, Homo sapiens
MVIGTRFEKGLGSRIRAMMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVWALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREWDLLLFLLRELVEKGLMGRMEIEACLGSLHQAQWPGDFAEELATLSNLFLAEPHLPEPQLRACELVQPNRGTVLAQS

SEQ ID NO: 738980 - protein, 686 aa, Homo sapiens
MMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVWALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREVSQTEQEALCSHTLNIHHPCPKL

SEQ ID NO: 738981 - protein, 750 aa, Homo sapiens
MPPSTQAVSFQPETDNRANFSSDRAFHTFKKQRDVFYEVLREWEDHHEEPGWDFEKGLGSRIRAMMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVWALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREVSQTEQEALCSHTLNIHHPCPKL

SEQ ID NO: 738982 - protein, 737 aa, Homo sapiens
PRVIGTRFEKGLGSRIRAMMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVWALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREWDLLLFLLRELVEKGLMGRMEIEACLGSLHQAQWPGVRSLLSFRWRENRCYISHLS

SEQ ID NO: 738983 - protein, 761 aa, Homo sapiens
MPNFCAAPNCTRKSTQSDLAFFRFPRDPARCQKWVENCRRADLEDKTPDQLNKHYRLCAKHFETSMICRTSPYRTVLRDNAIPTIFDLTSHLNNPHSRHRKRIKELSEDEIRTLKQKKIDETSEQEQKHKETNNSNAQNPSEEEGEGQDEDILPLTLEEKENKEYLKSLFEILILMGKQNIPLDGHEADEIPEGLFTPDNFQALLECRINSGEEVLRKRFETTAVNTLFCSKTQQRQMLEICESCIREETLREVRDSHFFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKNLQGQTSDVFFAAGSLTAVLHSLNEVMENIEVYHEFWFEEATNLATKLDIQMKLPGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 738984 - protein, 586 aa, Homo sapiens
MGKQNIPLDGHEADEIPEGLFTPDNFQALLECRINSGEEVLRKRFETTAVNTLFCSKTQQRQMLEICESCIREETLREVRDSHFFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKNLQGQTSDVFFAAGSLTAVLHSLNEVMENIEVYHEFWFEEATNLATKLDIQMKLPGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 738985 - protein, 761 aa, Homo sapiens; identical to SEQ ID NO: 738983

SEQ ID NO: 738986 - protein, 704 aa, Homo sapiens
MPNFCAAPNCTRKSTQSDLAFFRFPRDPARCQKWVENCRRADLEDKTPDQLNKHYRLCAKHFETSMICRTSPYRTVLRDNAIPTIFDLTSHLNNPHSRHRKRIKELSEDEIRTLKQKKIDETSEQEQKHKETNNSNAQNPSEEEGEGQDEDILPLTLEEKENKEYLKSLFEILILMGKQNIPLDGHEADEIPEGLFTPDNFQALLECRINSGEEVLRKRFETTAVNTLFCSKTQQRQMLEICESCIREETLREVRDSHFFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 738987 - protein, 165 aa, Homo sapiens
VNPHSVPIGANKTVPKDFQINRFGKEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 738988 - protein, 145 aa, Homo sapiens
MSLFVKLILCFPVDETSEQEQKHKETNNSNAQNPSEEEGEGQDEDILPLTLEEKENKEYLKSLFEILILMGKQNIPLDGHEADEIPEGLFTPDNFQALLECRINSGEEVLRKRFETTAVNTLFCSKTQQRQMLEICESCIREETL

SEQ ID NO: 738989 - protein, 88 aa, Homo sapiens
DGPFRKLEFLGGTQGTNRKCSKRKFGVLDCQANEGELSGHIKVRNQRLNLTNKRCWRAALGSVLVVRTHLQVAHGYVVGTDTRLPELS

SEQ ID NO: 738990 - protein, 570 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 738991 - protein, 552 aa, Homo sapiens
MNVVFAVKQYISKMIEDSGPGMKVLLMDKETTGIVSMVYTQSEILQKEVYLFERIDSQENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 738992 - protein, 534 aa, Homo sapiens
MVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 738993 - protein, 570 aa, Homo sapiens; identical to SEQ ID NO: 738990

SEQ ID NO: 738994 - protein, 570 aa, Homo sapiens; identical to SEQ ID NO: 738990

SEQ ID NO: 738995 - protein, 359 aa, Homo sapiens
NGRSRPGLIRPKDPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 738996 - protein, 200 aa, Homo sapiens
SCLGYFFCDSSIMAHLGKKPVSGGRPPRERRVDGIKGVSHVSLFQVRDSSRLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 738997 - protein, 95 aa, Homo sapiens
GDLEDLLAVPFNSISEASTLRDRPQDIIVFVIGGATYEEALTVYNLNRTTPGVRIVLGGTTVHNTKSFLEEVLASGLHSRSKESSQVTSRSASRR

SEQ ID NO: 738998 - protein, 552 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSKRFLREGLAF

SEQ ID NO: 738999 - protein, 372 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQVSPI

SEQ ID NO: 739000 - protein, 129 aa, Homo sapiens [sequence omitted]

SEQ ID NO: 739001 - protein, 534 aa, Homo sapiens; identical to SEQ ID NO: 738992

SEQ ID NO: 739002 - protein, 612 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKRALKSHQGQRAEDETVVGGRAQLPLLSPLQVFPTKQRCWRAALGSVLVVRTHLQVAHGYVVGTDTRLPELS

SEQ ID NO: 739003 - protein, 570 aa, Homo sapiens; identical to SEQ ID NO: 738990

SEQ ID NO: 739004 - protein, 526 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPLGNFSCCALWCLPGQSSLQEWCGSGYK

SEQ ID NO: 739005 - protein, 158 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQVWKERFNLSVES

SEQ ID NO: 739006 - protein, 162 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQARNWDPAQHKNQRQHK

SEQ ID NO: 739007 - protein, 278 aa, Homo sapiens
MLRSLLLHSLRLCAQTASCLVLFPRFLGTAFMLWLLDFLCIRKHFLGRRRRGQPEPEVELNSEGEEVPPDDPPICVSDDNRLCTLASLKAVWHGQKLDFFKQAHEGGPAPNSEVVLPDGFQSQHILDYAQGNRPLVLNFGSCTCPPFMARMSAFQRLVTKYQRDVDFLIIYIEEAHPSDGWVTTDSPYIIPQHRSLEDRVSAARVLQQGAPGCALVLDTMANSSSSAYGAYFERLYVIQSGTIMYQGGRGPDGYQVSELRTWLERYDEQLHGARPRRV

SEQ ID NO: 739008 - protein, 75 aa, Homo sapiens
LSCRAQGVLFRASLVLQGHQHAGCPGRVQVLQAEFNVGLVRPPLALAQCILLWGHLMRGHEVTDLTPSIWSWEPK

SEQ ID NO: 739009 - protein, 668 aa, Homo sapiens
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 739010 - protein, 212 aa, Homo sapiens
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQEENKFLSPSE

SEQ ID NO: 739011 - protein, 704 aa, Homo sapiens
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDAGGTVAPRGWAWEKRNCLGRARPGQAGATQRPLPPTVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 739012 - protein, 685 aa, Homo sapiens
MMPSPSDSSRSLTSRPSTRGLTHLRLHRPWLQALLTLGLVQVLLGILVVTFSMVASSVTTTESIKRSCPSWAGFSISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDAGGTVAPRGWAWEKRNCLGRARPGQAGATQRPLPPTVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 739013 - protein, 509 aa, Homo sapiens
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCSAIAQVPSPHRGTGLLIRHPHHRCCCHGPTATQASRPPVTLLTSGTFIPKCLRKKLLLFPLQIQGSALKPASSA

SEQ ID NO: 739014 - protein, 668 aa, Homo sapiens; identical to SEQ ID NO: 739009

SEQ ID NO: 739015 - protein, 240 aa, Homo sapiens
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLTSGTFIPKCLRKKLLLFPLQIQGSALKPASSA

SEQ ID NO: 739016 - protein, 144 aa, Homo sapiens
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLTSGTFIPKCLRKKLLLFPLQIQGSALKPASSA

SEQ ID NO: 739017 - protein, 193 aa, Homo sapiens
MLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 739018 - protein, 311 aa, Homo sapiens
MPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 739019 - protein, 591 aa, Homo sapiens
MTSTDRPLFFRPADAPGGGSMATSHPNTTATVLKLPNIATSLSFAGLFRLSVPNAHLLSLRPPMGLGPAPYSWLADSWPHPSRSPSAQEPRGSCCPSNPDPDDRYYNGEEFSFPHLASAHFSRPTGANRRAPGSPVSLRLVSPWGGCELGKPLQTYLHPGLGCKACVGEEVDPVGFPFVFHSVVLYVSVSASGPPSFFSAEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 739020 - protein, 193 aa, Homo sapiens; identical to SEQ ID NO: 739017

SEQ ID NO: 739021 - protein, 435 aa, Homo sapiens
MGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 739022 - protein, 562 aa, Homo sapiens
QRKELSHYTASFAYTPAVSFPHSEGLSGASSRPPMGLGPAPYSWLADSWPHPSRSPSAQEPRGSCCPSNPDPDDRYYNGEEFSFPHLASAHFSRPTGANRRAPGSPVSLRLVSPWGGCELGKPLQTYLHPGLGCKACVGEEVDPVGFPFVFHSVVLYVSVSASGPPSFFSAEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 739023 - protein, 591 aa, Homo sapiens; identical to SEQ ID NO: 739019

SEQ ID NO: 739024 - protein, 591 aa, Homo sapiens; identical to SEQ ID NO: 739019

SEQ ID NO: 739025 - protein, 417 aa, Homo sapiens
MTSTDRPLFFRPADAPGGGSMATSHPNTTATVLKLPNIATSLSFAGLFRLSVPNAHLLSLRPPMGLGPAPYSWLADSWPHPSRSPSAQEPRGSCCPSNPDPDDRYYNGEEFSFPHLASAHFSRPTGANRRAPGSPVSLRLVSPWGGCELGKPLQTYLHPGLGCKACVGEEVDPVGFPFVFHSVVLYVSVSASGPPSFFSAEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRNQDDPCWGIENIMSATGKGSRDVFSPPAVMSGAS

SEQ ID NO: 739026 - protein, 122 aa, Homo sapiens
GAGVRAGARAKGQDRNAERNQDDPCWGIENIMSATGKGSRDVFSPSAQEPRGSCCPSNPDPDDRYYNGEEFSFPHLASAHFSRPTGANRRAPGSPVSLRSRNLPVSSSDGQGHGRPWRGSCL

SEQ ID NO: 739027 - protein, 452 aa, Homo sapiens
MTSTDRPLFFRPADAPGGGSMATSHPNTTATVLKLPNIATSLSFAGLFRLSVPNAHLLSLRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSAQSQRSGARQCLERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 739028 - protein, 646 aa, Homo sapiens
MTSTDRPLFFRPADAPGGGSMATSHPNTTATVLKLPNIATSLSFAGLFRLSVPNAHLLSLRPPMGLGPAPYSWLADSWPHPSRSPSAQEPRGSCCPSNPDPDDRYYNGEEFSFPHLASAHFSRPTGANRRAPGSPVSLRLVSPWGGCELGKPLQTYLHPGLGCKACVGEEVDPVGFPFVFHSVVLYVSVSASGPPSFFSAEAGISLYLAQTARGTAAPGEGPVYSTIDPAGEELQTFHGGFPQHPSGDLGPWSQYAPPEWSQGDSGMTPTPETPFSPDQGIPKEDPPPDPLAPSPALPSDLSHLWLFPACSPGVPILFSSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 739029 - protein, 311 aa, Homo sapiens; identical to SEQ ID NO: 739018

SEQ ID NO: 739030 - protein, 555 aa, Homo sapiens
GKPPTGVAVPAGSGMTLSQFQVSGPSSPHFSDPHSVPAGLEPGLEVGAGLAVRLARVLRARLPRGQRRSLRGAASRALRRLYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 739031 - protein, 311 aa, Homo sapiens; identical to SEQ ID NO: 739018

SEQ ID NO: 739032 - protein, 160 aa, Homo sapiens [sequence omitted]

SEQ ID NO: 739033 - protein, 162 aa, Homo sapiens
SLPPRLQFSSVCFVSSARRSPASVALRPAGPGRPTAKMPGPPGSFEVGALTFRDVAIEFSLEEWQCLDTEQQNLYRNVMLDNYRNLVFLGIAVSKPDLITCLEQEKEPWNLKTHDMVAKPPGTAFSIFYMFVKFYKYMQCQYTFSEFGYFGTSFFHFSGQIC

SEQ ID NO: 739034 - protein, 174 aa, Homo sapiens
VDVSRSRQSLGLVFTVPRPLPGNHRPPPGDFVTASVALRPAGPGRPTAKMPGPPGSFEVGALTFRDVAIEFSLEEWQCLDTEQQNLYRNVMLDNYRNLVFLGIAVSKPDLITCLEQEKEPWNLKTHDMVAKPPGTAFSIFYMFVKFYKYMQCQYTFSEFGYFGTSFFHFSGQIC

SEQ ID NO: 739035 - protein, 70 aa, Homo sapiens
ASPCFDSRMVRAALTCAHCLALPSEMNPVPQMEMQKSPVFCALTLGAVDRSCSYSAILSPPVNWKFPVSP

SEQ ID NO: 739036 - protein, 70 aa, Homo sapiens; identical to SEQ ID NO: 739035

SEQ ID NO: 739037 - protein, 128 aa, Homo sapiens [sequence omitted]

SEQ ID NO: 739038 - protein, 145 aa, Homo sapiens [sequence omitted]

SEQ ID NO: 739039 - protein, 121 aa, Homo sapiens
QVEAREAHAGHMLHTLAPLWLQLHPPTQHSPHDLSSPSPRHSQGSPGHPQLFSGLLEYQTTHLSLSSSLPPLHPASHQVPQVSKLELTAVGTYGIYWIWLTHTWYSYLHLLYLPGLHKLQS

SEQ ID NO: 739040 - protein, 138 aa, Homo sapiens
PDGSPLCGPGRGVPGPPLEACPCRCVQSVSIAAFASLGAFGAFVGFVYPWQGISQALIGSPGFQSHVLNGASNCNGPPIGRIGYPAPPSKVDLVSVMSSWLLGLVGSPRSREQLRWSSVPSFFLPTRPPGARWIEEPQ

SEQ ID NO: 739041 - protein, 142 aa, Homo sapiens [sequence omitted]

SEQ ID NO: 739042 - protein, 30 aa, Homo sapiens
MEQISITQMTMLQMSGVQGWRVLQAGFLSL

SEQ ID NO: 739043 - protein, 331 aa, Homo sapiens
MVLCRLQGCPCKHLDEKTGILLEVCTFPTSAKMDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 739044 - protein, 104 aa, Homo sapiens
MAFISPKVPGMVLGTKVLSIPSLLGDSLSLHSGRPFTTYDADHDSSNSNCAVIVHGAWWYASCYRSNLNGRYAVSEAAAHKYGIDWASGRGVGHPYRRVRMMLR

SEQ ID NO: 739045 - protein, 299 aa, Homo sapiens
MDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 739046 - protein, 320 aa, Homo sapiens
MVLCRLQGCPCKHLDEKTGILLEVCTFPTSAKMDLLWILPSLWLLLLGGPACLKTQEHPSCPGPRELEASKVVLLPSCPGAPGSPGEKGAPGPQGPPGPPGKMGPKGEPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 739047 - protein, 406 aa, Homo sapiens
MVLCRLQGCPCKHLDEKTGILLEVCTFPTSAKMDLLWILPSLWLLLLGGPACLKTQEHPSCPGPRELEASKVVLLPSCPGAPGSPGEKGAPGPQGPPGPPGKMGPKGEPGDPVNLLRCQEGEAALAGARNLGSHGVGCWQTPKCGQDPPHSLLRTLLQGPEGAKRVPEGPTLVPVPGGGGQGITWAPPQSISPFPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 739048 - protein, 395 aa, Homo sapiens
MVLCRLQGCPCKHLDEKTGILLEVCTFPTSAKMDLLWILPSLWLLLLGGPACLKTQEHPSCPGPRELEASKVVLLPSCPGAPGRPPGPPGKMGPKGEPGDPVNLLRCQEGEAALAGARNLGSHGVGCWQTPKCGQDPPHSLLRTLLQGPEGAKRVPEGPTLVPVPGGGGQGITWAPPQSISPFPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 739049 - protein, 141 aa, Homo sapiens
MVLCRLQGCPCKHLDEKTGILLEVCTFPTSAKMDLLWILPSLWLLLLGGPACLKTQEHPSCPGPRELEASKVVLLPSCPGAPGSPGEKGAPGPQGERGWGAGWDLGNGEGRKVAIFVCAEGPRQRSKEPTLCQLQAGHPAS

SEQ ID NO: 739050 - protein, 393 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 739051 - protein, 205 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQGSTLELGAWGFTRGLSQRVQTRPGKRRGENNDWGPLALDVAPHQEDGLCGHYSGPERSACTEK

SEQ ID NO: 739052 - protein, 353 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMRSWWSCGGWKINLMQLVGKAARGRDSGEPFTGKPVPARQLVSPPNGDRPGGRAAVNTQGAERHAGVGQGRAGITGKRDTSGHREREHHRRKEEKKENERKRRYETSNNQEQRHGTG

SEQ ID NO: 739053 - protein, 93 aa, Homo sapiens
PYAGAVESPLSVSFASGCVALPVLMNIKAVIEQRQCTGVWNHKDELPIEIELGMKCWYHSVFAPLPLGPRVSSGGPPLPPTTASTVCTISHCK

SEQ ID NO: 739054 - protein, 393 aa, Homo sapiens; identical to SEQ ID NO: 739050

SEQ ID NO: 739055 - protein, 393 aa, Homo sapiens; identical to SEQ ID NO: 739050

SEQ ID NO: 739056 - protein, 393 aa, Homo sapiens; identical to SEQ ID NO: 739050

SEQ ID NO: 739057 - protein, 393 aa, Homo sapiens; identical to SEQ ID NO: 739050

SEQ ID NO: 739058 - protein, 333 aa, Homo sapiens
MSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 739059 - protein, 333 aa, Homo sapiens; identical to SEQ ID NO: 739058

SEQ ID NO: 739060 - protein, 393 aa, Homo sapiens; identical to SEQ ID NO: 739050

SEQ ID NO: 739061 - protein, 393 aa, Homo sapiens; identical to SEQ ID NO: 739050

SEQ ID NO: 739062 - protein, 393 aa, Homo sapiens; identical to SEQ ID NO: 739050

SEQ ID NO: 739063 - protein, 393 aa, Homo sapiens; identical to SEQ ID NO: 739050

SEQ ID NO: 739064 - protein, 393 aa, Homo sapiens; identical to SEQ ID NO: 739050

SEQ ID NO: 739065 - protein, 333 aa, Homo sapiens; identical to SEQ ID NO: 739058

SEQ ID NO: 739066 - protein, 393 aa, Homo sapiens; identical to SEQ ID NO: 739050

SEQ ID NO: 739067 - protein, 393 aa, Homo sapiens; identical to SEQ ID NO: 739050

SEQ ID NO: 739068 - protein, 393 aa, Homo sapiens; identical to SEQ ID NO: 739050

SEQ ID NO: 739069 - protein, 464 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEEGGPWVGQQHSASTSQGTGLDCGLHFTQMYLTCLQPCLKSLTQAFGALLSGAGSQVLAPTSSTLNWPLSSRWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 739070 - protein, 337 aa, Homo sapiens
TWPAPGVGWEHPEAGMYKDSKESQQECPHHQALSLLLRQNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 739071 - protein, 393 aa, Homo sapiens; identical to SEQ ID NO: 739050

SEQ ID NO: 739072 - protein, 157 aa, Homo sapiens [sequence omitted]

SEQ ID NO: 739073 - protein, 174 aa, Homo sapiens
MIIALRARVSLVCRFSLVVTASVCGCVGLESPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 739074 - protein, 119 aa, Homo sapiens
PYAGAVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 739075 - protein, 354 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMRSWWSCGGWKINLMQLVGKAARGRDSGEPFTGKPVPARQLVSPPNGDRPGGRAAVNTQGAMSGMPGSAKEEQEEQERETRVGTARENTTDVRRSKKENERKRRYETSNNQEQRHGTG

SEQ ID NO: 739076 - protein, 213 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSPWHKEREMLASVLLLSFPVSVCV

SEQ ID NO: 739077 - protein, 151 aa, Homo sapiens
KENWKRTVLIPDSVLVMPVLILQKQPGLPPPQWILQSNLPEGIFIPAQSPQGLGSHRAQHIVLCCTVLLPAWGWTQSPAPPELPPLVALYEIQVMMGSLVYLRLGLEKSPYCHLLDSSHWAEICETFTRDACSLLGLSVESPLSVRYNPAL

SEQ ID NO: 739078 - protein, 72 aa, Homo sapiens
DSGLSKAFGPKVRASGLFLTPAPGSGPMTVSLCPSVASHSGLLLGFLLAALLMAVLWLLAAPRGSEEPMPAP

SEQ ID NO: 739079 - protein, 191 aa, Homo sapiens
PETSRIHFQQEHWPSQLLLRESLEDMMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 739080 - protein, 123 aa, Homo sapiens
PETSRIHFQQEHWPSQLLLRESLEDMMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKWFHA

SEQ ID NO: 739081 - protein, 536 aa, Homo sapiens
RASRAARCLCGRRRRPGRQPRRGARRLAAAPGLNMRCSPGGVWLALAASLLHVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 739082 - protein, 536 aa, Homo sapiens; identical to SEQ ID NO: 739081

SEQ ID NO: 739083 - protein, 321 aa, Homo sapiens
MQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 739084 - protein, 536 aa, Homo sapiens; identical to SEQ ID NO: 739081

SEQ ID NO: 739085 - protein, 494 aa, Homo sapiens
EPPARVFSPQVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 739086 - protein, 412 aa, Homo sapiens
MQKYCIYQHFQFQLLIQHLWIAANCDIADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 739087 - protein, 536 aa, Homo sapiens; identical to SEQ ID NO: 739081

SEQ ID NO: 739088 - protein, 321 aa, Homo sapiens; identical to SEQ ID NO: 739083

SEQ ID NO: 739089 - protein, 321 aa, Homo sapiens; identical to SEQ ID NO: 739083

SEQ ID NO: 739090 - protein, 321 aa, Homo sapiens; identical to SEQ ID NO: 739083

SEQ ID NO: 739091 - protein, 83 aa, Homo sapiens
SPFPGGSGGSGAVALLNCGLTGAAPPVGGVGYKGSSPAGRHIAPAKSSVPLAIFQPRSHEGHGGGERWSRESSAGGPAWWPRP

SEQ ID NO: 739092 - protein, 117 aa, Homo sapiens
CPHSPGFYLISPSEFERFSLSTKWLVEPRCLVDSAETKNHRPGNGAGPKKAPSRARNSGTQSDGEEKQPGLVMERALLSDERVLKEIQSTLEGDRGSGNWRSHRAAVGCSLSNGGAE

SEQ ID NO: 739093 - protein, 112 aa, Homo sapiens
CPHSPGFYLISPSEFERFSLSTKWLVEPRCLVDSAETKNHRPGNGAGPKKAPSRARNSGTQSDGEEKQPGLVMERALLSDERAATGVHIERPWGAASAMAEQSEWLSVQAAR

SEQ ID NO: 739094 - protein, 86 aa, Homo sapiens
IGIIPHRQCQPWDSNLHRLLPLPQCLQGPTAVKCEIQSNPDGGASRRLTFSEFYKRVSPLPVFEDDIFVRLYLPHVSVASEFLELG

SEQ ID NO: 739095 - protein, 88 aa, Homo sapiens
AACLSAALGYLDVRIVDTDYSSFAVLYIYKELEGALSTMVQLYSRTQDVSPQALKSFQDFYPTLGLPKDMMVMLPQSDACNPESKEAP

SEQ ID NO: 739096 - protein, 89 aa, Homo sapiens
ILTLLWAPTAQAEVLLQPDFNAEKGFLGKKDHLSMSTRAIRPTEEGGLHVHMEFPGADGCNQVDAEYLESLHPPPPACGMPCGTSLSIQ

SEQ ID NO: 739097 - protein, 1387 aa, Homo sapiens
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 739098 - protein, 738 aa, Homo sapiens
GDRLRHKERLGESRRLLDSRRRGSPVTRPPRKMDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEIYSPCLQIPLINCSSPSHGAKVHPWNLCPHSSQGSYGQSAEGVM

SEQ ID NO: 739099 - protein, 713 aa, Homo sapiens
GDRLRHKERLGESRRLLDSRRRGSPVTRPPRKMDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEWFQHQHWLYWRTQHQHGLQ

SEQ ID NO: 739100 - protein, 316 aa, Homo sapiens
GDRLRHKERLGESRRLLDSRRRGSPVTRPPRKMDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEWFQHQHWLYWRTQHQHGLQ

SEQ ID NO: 739101 - protein, 341 aa, Homo sapiens
GDRLRHKERLGESRRLLDSRRRGSPVTRPPRKMDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEIYSPCLQIPLINCSSPSHGAKVHPWNLCPHSSQGSYGQSAEGVM

SEQ ID NO: 739102 - protein, 1602 aa, Homo sapiens
GDRLRHKERLGESRRLLDSRRRGSPVTRPPRKMDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGYDWALSALAVRVVLWQERMVLGLHQSGGLVDGWGAGLGRGPRVLTWVDDGQMVLNSLLSLSLMSSVCSKLEMLDRPSGIPDKEASGLNCLLLVAMCSYFLHFIETAPCAREVSSMLGNASALIWAVLICVHVVIFPIVRVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 739103 - protein, 1577 aa, Homo sapiens
GIGSDTRRGLERADAFWIQEDEGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGYDWALSALAVRVVLWQERMVLGLHQSGGLVDGWGAGLGRGPRVLTWVDDGQMVLNSLLSLSLMSSVCSKLEMLDRPSGIPDKEASGLNCLLLVAMCSYFLHFIETAPCAREVSSMLGNASALIWAVLICVHVVIFPIVRVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 739104 - protein, 1526 aa, Homo sapiens
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGYDWALSALAVRVVLWQERMVLGLHQSGGLVDGWGAGLGRGPRVLTWVDDGQMVLNSLLSLSLMSSVCSKLEMLDRPSGIPDKEASGLNCLLLVAMCSYFLHFIETAPCAREVSSMLGNASALIWAVLICVHVVIFPIVRVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 739105 - protein, 814 aa, Homo sapiens [sequence omitted]

SEQ ID NO: 739106 - protein, 1442 aa, Homo sapiens
GDRLRHKERLGESRRLLDSRRRGSPVTRPPRKMDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 739107 - protein, 1602 aa, Homo sapiens; identical to SEQ ID NO: 739102

SEQ ID NO: 739108 - protein, 787 aa, Homo sapiens
MEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 739109 - protein, 637 aa, Homo sapiens
GDRLRHKERLGESRRLLDSRRRGSPVTRPPRKMDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGYDWALSALAVRVVLWQERMVLGLHQSGGLVERVGCWTG

SEQ ID NO: 739110 - protein, 496 aa, Homo sapiens
GDRLRHKERLGESRRLLDSRRRGSPVTRPPRKMDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVASRMASEVSDLFPMFTDTANKLQ

SEQ ID NO: 739111 - protein, 172 aa, Homo sapiens
GDRLRHKERLGESRRLLDSRRRGSPVTRPPRKMDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQITKVHPWNLCPHSSQGSYGQSAEGVM

SEQ ID NO: 739112 - protein, 69 aa, Homo sapiens
NLNLLTTDVGIFTDCPQLPSPNITFILTSQLPQKPRSMKYYKLETNSLLYTNCKSKPRRKRIYAYLYSK

SEQ ID NO: 739113 - protein, 146 aa, Homo sapiens
MCQRLWPWPANQPLPGGLLPRPLSLAPSSSSSCCSPPCSQDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILI

SEQ ID NO: 739114 - protein, 121 aa, Homo sapiens
MSGCFPVSGLRCLSRDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILI

SEQ ID NO: 739115 - protein, 121 aa, Homo sapiens; identical to SEQ ID NO: 739114

SEQ ID NO: 739116 - protein, 121 aa, Homo sapiens; identical to SEQ ID NO: 739114

SEQ ID NO: 739117 - protein, 293 aa, Homo sapiens
MRRAAGGSTCGSACPSTSTRKKTPTKRPSSSPSPRARRAVAWALALAQAGALGAWGPRAVRAAQAPAQAGPSPQTPAPRRCMMWPRLRSTSRRPRGRAHRSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 739118 - protein, 1180 aa, Homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 739119 - protein, 1212 aa, Homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 739120 - protein, 331 aa, Homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGRNQMPSLLRSQRTASYGKTEENAKVASF

SEQ ID NO: 739121 - protein, 444 aa, Homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNTLEAGSRRSGCEHSWVLVKAHFPAYRQPPSCYVHTWQKGREIQGMNQIFFVSSLSSHWYLFS

SEQ ID NO: 739122 - protein, 963 aa, Homo sapiens
WQEWASSKKDEFSPFPFSLAHIFARLFVCQHGIKQQESACQIWVLEPWTAQPPELDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 739123 - protein, 985 aa, Homo sapiens
MEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 739124 - protein, 254 aa, Homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGRGTKKEEMRKRDQTLMLSFMRFKLFSCLSLQRS

SEQ ID NO: 739125 - protein, 361 aa, Homo sapiens
MWVLTPAAFAGKLLSVFRQPLSSLWRSLVPLFCWLRATFWLLATKRRKQQLVLRGPDETKEEEEDPPLPTTPTSVNYHFTRQCNYKCGFCFHTAKTSFVLPLEEAKRGLLLLKEAGMEKINFSGGEPFLQDRGEYLGKLVRFCKVELRLPSVSIVSNGSLIRERWFQNYGEYLDILAISCDSFDEEVNVLIGRGQGKKNHVENLQKLRRWCRDYRVAFKINSVINRFNVEEDMTEQIKALNPVRWKVFQCLLIEGENCGEDALREAERFVIGDEEFERFLERHKEVSCLVPESNQKMKDSYLILDEYMRFLNCRKGRKDPSKSILDVGVEEAIKFSGFDEKMFLKRGGKYIWSKADLKLDW

SEQ ID NO: 739126 - protein, 378 aa, Homo sapiens
KRVPGIQRLALLQASATMWVLTPAAFAGKLLSVFRQPLSSLWRSLVPLFCWLRATFWLLATKRRKQQLVLRGPDETKEEEEDPPLPTTPTSVNYHFTRQCNYKCGFCFHTAKTSFVLPLEEAKRGLLLLKEAGMEKINFSGGEPFLQDRGEYLGKLVRFCKVELRLPSVSIVSNGSLIRERWFQNYGEYLDILAISCDSFDEEVNVLIGRGQGKKNHVENLQKLRRWCRDYRVAFKINSVINRFNVEEDMTEQIKALNPVRWKVFQCLLIEGENCGEDALREAERFVIGDEEFERFLERHKEVSCLVPESNQKMKDSYLILDEYMRFLNCRKGRKDPSKSILDVGVEEAIKFSGFDEKMFLKRGGKYIWSKADLKLDW

SEQ ID NO: 739127 - protein, 286 aa, Homo sapiens
MRPKRRKRTLLCPPPQPASTITSLASATTNAASVSTQPKHRMEKINFSGGEPFLQDRGEYLGKLVRFCKVELRLPSVSIVSNGSLIRERWFQNYGEYLDILAISCDSFDEEVNVLIGRGQGKKNHVENLQKLRRWCRDYRVAFKINSVINRFNVEEDMTEQIKALNPVRWKVFQCLLIEGENCGEDALREAERFVIGDEEFERFLERHKEVSCLVPESNQKMKDSYLILDEYMRFLNCRKGRKDPSKSILDVGVEEAIKFSGFDEKMFLKRGGKYIWSKADLKLDW

SEQ ID NO: 739128 - protein, 178 aa, Homo sapiens
MWVLTPAAFAGKLLSVFRQPLSSLWRSLVPLFCWLRATFWLLATKRRKQQLVLRGPDETKEEEEDPPLPTTPTSVNYHFTRQCNYKCGFCFHTAKTSYGEDQLFRWRAISSRPGRIPGQVGEVLQSRVAAAQREHRDKTKIRFPFDDGVDMEAVLALLCSPIIWPHEAVKQKNRSVVE

SEQ ID NO: 739129 - protein, 256 aa, Homo sapiens [sequence omitted]

SEQ ID NO: 739130 - protein, 124 aa, Homo sapiens
SFALLPRLACSGVVSAHCSLRLLGSRQSSASVSGVAGTAGTCHHAQLIFVFLVETGFCRVGQASLELLTSSDLSASASRSAGIIGVSHRILPRHTKFDRYCVPFGSLGINFCLCHSALYILKWR

SEQ ID NO: 739131 - protein, 81 aa, Homo sapiens
GTCVRQGCSDNQVSSTGGGMGMVTVVLLMSPMMLSASFSAWCMCSISSCCCACSANSSISVFWFPHEYILASGSEMMNSGV

SEQ ID NO: 739132 - protein, 68 aa, Homo sapiens
DVHTREQGFFWFRKVLRPWAHFHKCEKASSNVTSREKPCLASRPPRHSQHESCCVVTIVLLICACRIP

SEQ ID NO: 739133 - protein, 210 aa, Homo sapiens
MEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 739134 - protein, 584 aa, Homo sapiens
PPSEASVEPVVRRMERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 739135 - protein, 584 aa, Homo sapiens; identical to SEQ ID NO: 739134

SEQ ID NO: 739136 - protein, 48 aa, Homo sapiens
MVPGNGTEGVLSIPCRSRGAVYPQVGLGTAAHEGKGLRAWRQKWRAIS

SEQ ID NO: 739137 - protein, 30 aa, Homo sapiens
MQECPDTPGSCCVFSGWLLNLQEPQEPHWS

SEQ ID NO: 739138 - protein, 143 aa, Homo sapiens
RGWQRRGPGSGAVGREPWGGMEGLVVAAGGDVSLHNFSARLWEQLVHFHVMRLTDSLFLWVGATPHLRNLAVAMCSRYDSIPVSTSLLGDTSDTTSTGLAQRLARKTNKQVFVSYNLQNTDSNFALLVENRIKEEMEAFPEKF

SEQ ID NO: 739139 - protein, 96 aa, Homo sapiens
RGWQRRGPGSGAVGREPWGGMEGLVVAAGGDVSLHNFSARLWEQLVHFHVMRLTDSLFLWVGATPHLRNLAVAMCSRYTGSEPAVGLRYPATASTK

SEQ ID NO: 739140 - protein, 124 aa, Homo sapiens
RGWQRRGPGSGAVGREPWGGMEGLVVAAGGDVSLHNFSARLWEQLVHFHVMRLTDSLFLWVGATPHLRNLAVAMCSRYDSIPVSTSLLGDTSDTTSTGLAQRLGMYPQLALHGQPGGAHSLMEP

SEQ ID NO: 739141 - protein, 85 aa, Homo sapiens
LHRSPTSPAYHVLVILFEEQGHTDGLHVRSGGSRMFGGSRSKINSARKTNKQVFVSYNLQNTDSNFALLVENRIKEEMEAFPEKF

SEQ ID NO: 739142 - protein, 143 aa, Homo sapiens; identical to SEQ ID NO: 739138

SEQ ID NO: 739143 - protein, 128 aa, Homo sapiens
RGWQRRGPGSGAVGREPWGGMEGLVVAAGGDVSLHNFSARLWEQLVHFHVMRLTDSLFLWVGATPHLRNLAVAMCSRYDSIPVSTSLLGDTSDTTSTGLAQRLGRTVLTQCDTVQGSEGRLAWPVSVA

SEQ ID NO: 739144 - protein, 166 aa, Homo sapiens
SCGRVQALRRGILVHPFLLPRLHSSPNENKTMCVGRGVGGVGSFSFSEVTFVGRWLPVLQAVTHGLASGQALSIRTQPAFPLPNPVTAWASSRELEIGFALMCGSSLSLPSVLLLWLQECGSGCLCVVDGKFAAQSGPTRPRGSVTASGENHGEPCRLRTGPVHLR

SEQ ID NO: 739145 - protein, 41 aa, Homo sapiens
MNSWWLHPIPPACMWGLSGLQACLGKPLCKFPYLHKTSHVT

SEQ ID NO: 739146 - protein, 453 aa, Homo sapiens
MLKMVLTENPNQEIATSLEFLLLQNSPGSLRAQQRMSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 739147 - protein, 453 aa, Homo sapiens; identical to SEQ ID NO: 739146

SEQ ID NO: 739148 - protein, 450 aa, Homo sapiens [sequence omitted]

SEQ ID NO: 739149 - protein, 453 aa, Homo sapiens; identical to SEQ ID NO: 739146

SEQ ID NO: 739150 - protein, 453 aa, Homo sapiens; identical to SEQ ID NO: 739146

SEQ ID NO: 739151 - protein, 453 aa, Homo sapiens; identical to SEQ ID NO: 739146

SEQ ID NO: 739152 - protein, 1745 aa, Homo sapiens [sequence omitted]

SEQ ID NO: 739153 - protein, 1745 aa, Homo sapiens [sequence omitted]

SEQ ID NO: 739154 - protein, 1776 aa, Homo sapiens
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILEGSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRVRGWGSGQLERGGKMSATFPVTHRLCLLWGQLRKGQTKTLFEFSSSRAGFLPLWDVAATDFGQTNQKFGFELGPVCFSS

SEQ ID NO: 739155 - protein, 1492 aa, Homo sapiens
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILEGSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPVSTPCFRGLTHPSSPPPSLHQNPP

SEQ ID NO: 739156 - protein, 104 aa, Homo sapiens
MPMNIRGPMWSVLLNTEEMKLKNPGRYQIMKEKGKRSSEHIQRIDRDVSGTLRKHIFFRDRYGTKQRELLHILLAYEEYNPRKPLLQRKPLQSPLPFSNDMSPP

SEQ ID NO: 739157 - protein, 135 aa, Homo sapiens
MLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVSKNVKHRPMGES

SEQ ID NO: 739158 - protein, 97 aa, Homo sapiens
MPMNIRGPMWSVLLNTEEMKLKNPGRYQIMKEKGKRSSEHIQRIDRDVSGTLRKHIFFRDRYGTKHGGTTPHSLHVGIMTEYNPEDNLMAFMRGQPY

SEQ ID NO: 739159 - protein, 96 aa, Homo sapiens
VARVQGEAGGCWEVRTCKGLGAVKWGGPLVQPEYTGQVSGQAPLTLAGGCGHSLRDSCQGPVAHPGRPPSHLRANLSQLQQKAPPRVQDGQPHWAA

SEQ ID NO: 739160 - protein, 660 aa, Homo sapiens
MEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739161 - protein, 809 aa, Homo sapiens
MNVIDRKPYPDDENLVEVKFARTPVTSTYLVAFVVGEYDFVETRSKDGVCVCVYTPVGKAEQGKFALEVAAKTLPFYKDYFNVPYPLPKIDLIAIADFAAGAMENWDLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739162 - protein, 707 aa, Homo sapiens
MENWDLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739163 - protein, 945 aa, Homo sapiens
VEAAAQVRQATNQIVMNVLDIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVTSTYLVAFVVGEYDFVETRSKDGVCVCVYTPVGKAEQGKFALEVAAKTLPFYKDYFNVPYPLPKIDLIAIADFAAGAMENWDLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739164 - protein, 926 aa, Homo sapiens
VEAAAQVRQATNQIVMNVLDIDIITASYAPEGDEEIHATGFNYQNEDEKVTLSFPSTLQTGTGTLKIDFVGELNDKMKGFYEATDARRAFPCWDEPAIKATFDISLVVPKDRVALSNMNVIDRKPYPDDENLVEVKFARTPVTSTYLVAFVVGEYDFVETRSKDGVCVCVYTPVGKAEQGKFALEVAAKTLPFYKDYFNVPYPLPKIDLIAIADFAAGAMENWDLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739165 - protein, 752 aa, Homo sapiens
MNVIDRKPYPDDENLVEVKFARTPVTSTYLVAFVVGEYDFVETRSKDGVCVCVYTPVGKAEQGKFALEVNVLRRGLFQQSITPGAMENWDLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVESFGDCTLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739166 - protein, 578 aa, Homo sapiens
MLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739167 - protein, 469 aa, Homo sapiens
MLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739168 - protein, 568 aa, Homo sapiens
KGFLPERHDPGQLIHQNQRMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739169 - protein, 448 aa, Homo sapiens
MPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739170 - protein, 509 aa, Homo sapiens
SVPADPLKLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLPPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739171 - protein, 578 aa, Homo sapiens; identical to SEQ ID NO: 739166

SEQ ID NO: 739172 - protein, 448 aa, Homo sapiens; identical to SEQ ID NO: 739169

SEQ ID NO: 739173 - protein, 642 aa, Homo sapiens
MEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLNIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLQPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739174 - protein, 638 aa, Homo sapiens
MEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGFHSPNGGTVQGLQDQQEHVVATSQPKTMGHQISLGLTLRLWDVYLVEGEQALMPITRIAFKVQQKRLTKTSRCGPWARFCNRFVDTWARDEDTVLKHLRASMKKLTRKQGDLQPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739175 - protein, 90 aa, Homo sapiens
SMIELGTPWFRHYDFRQSCWVRAISQEDQLAPCWQAEHPAERVRSAFAAPSTDSDQGTPFRARDEQPCAPTSGPCLCGLHLESSQFPPGF

SEQ ID NO: 739176 - protein, 660 aa, Homo sapiens; identical to SEQ ID NO: 739160

SEQ ID NO: 739177 - protein, 660 aa, Homo sapiens; identical to SEQ ID NO: 739160

SEQ ID NO: 739178 - protein, 263 aa, Homo sapiens
MNVIDRKPYPDDENLVEVKFARTPVTSTYLVAFVVGEYDFVETRSKDGVCVCVYTPVGKAEQGKFALEVAAKTLPFYKDYFNVPYPLPKIDLIAIADFAAGAMENWDLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAAAGNL

SEQ ID NO: 739179 - protein, 335 aa, Homo sapiens
MEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQRELLHILLAYEEYNPEVGYCRDLSHIAALFLLYLPEEDAFWALVQLLASERHSLQGK

SEQ ID NO: 739180 - protein, 217 aa, Homo sapiens
MEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVSKNVKHRPMGES

SEQ ID NO: 739181 - protein, 283 aa, Homo sapiens
MEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAARMDVVEVAGSWWAQEREDIIMKYEKGHRAGLPEDKGPKPFRSYNNNVDHLGIVHETELPPLTAREAKQIRREISRKSKWVDMLGDWEKYKSSRKLIDRAYKGMPMNIRGPMWSVLLNTEEMKLKNPGRYQIMKEKGKRSSEHIQRIDRDVSGTLRKHIFFRDRYGTKQAYGSH

SEQ ID NO: 739182 - protein, 134 aa, Homo sapiens
PVSRAVKEFTKTVIGKGRFIGESVKICCKVAVSSTAEKGKSAKTQRLEGRFTWSCWRGLLAECSRAPGATCRRSSLRVITHCSPPPGPLPLCCLLTLSGLTYLIRTTHYVLGHFISENLLFKNNTSIILKARRI

SEQ ID NO: 739183 - protein, 514 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 739184 - protein, 106 aa, Homo sapiens
FFNSRHSHVLQETSRGNKLSSVRPTNVLEMMKEWKNNPESVEENTTEEKNKPSTEEKLKSYQPWGNVPDANYTSDEEEEKQATAYEKNTPCFYLRLFFFPLLKFFI

SEQ ID NO: 739185 - protein, 489 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYDGLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 739186 - protein, 448 aa, Homo sapiens
MSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPTLYGLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 739187 - protein, 489 aa, Homo sapiens; identical to SEQ ID NO: 739185

SEQ ID NO: 739188 - protein, 489 aa, Homo sapiens; identical to SEQ ID NO: 739185

SEQ ID NO: 739189 - protein, 489 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQAIMWDSYLYGLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 739190 - protein, 489 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATMWDSYLYGLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 739191 - protein, 489 aa, Homo sapiens; identical to SEQ ID NO: 739185

SEQ ID NO: 739192 - protein, 512 aa, Homo sapiens
GCRIPGSATACAECAHLSETRQSAGRGGHYFSAHPAFWLISSLHLTTPLPTPGKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYDGLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 739193 - protein, 146 aa, Homo sapiens
FTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPK

SEQ ID NO: 739194 - protein, 78 aa, Homo sapiens
TDYVGISRNLDFAPGVRMQTFQVTILDDLGQPTLEGPEKFELLLQMPMGAVLGEPNKTTIFIEDTITDCKQSACSSFD

SEQ ID NO: 739195 - protein, 78 aa, Homo sapiens; identical to SEQ ID NO: 739194

SEQ ID NO: 739196 - protein, 973 aa, Homo sapiens
METRERKKSRAEFGTRATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMILLSVRVFFKKCPSIVQNFAVFPETMTGAESTSLVIARGTCIPNAEEVDVPIKLYCNGDGEWMVPIGRCTCKPGYEPENSVACKACPAGRFKASQEAEGCSHCPSNSRSPAEASPICTCRTGYYRADFDPPEVACTSVPSGPRNVISIVNESSIILEWHPPRETGGRDDVTYNIICKKCRADGRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMASSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 739197 - protein, 984 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMILLSVRVFFKKCPSIVQNFAVFPETMTGAESTSLVIARGTCIPNAEEVDVPIKLYCNGDGEWMVPIGRCTCKPGYEPENSVACKACPAGRFKASQEAEGCSHCPSNSRSPAEASPICTCRTGYYRADFDPPEVACTSVPSGPRNVISIVNESSIILEWHPPRETGGRDDVTYNIICKKCRADGRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMASSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 739198 - protein, 315 aa, Homo sapiens
MHTHTHARPHRPTRTHSCPRPRSAPGSPVRARARKDTEKPPAESAAAPWDAALSRRCCLGLVSACGPSAGDGPGLSTTAPPGIRSGCDGRERTLHGARWLLVPAAWDCCAPRFAGFLWLLCGAGIPGPEGKEVWEPRPLPSAGLGRHPPERPRLALSARNWLASPPASSPRHSLVASVSRSPRSESSEPAALRCMLLSSGAEPELGVGEKGVPLAIRLLEYWRPSAPRHGYASEQPRATSFSPARSPRASGLCLACKHCARGPEKLCRGIPQVAAEGEGWSSLAVPLGTSLVVRAPAGLHVSRVSRGEVETLFAS

SEQ ID NO: 739199 - protein, 984 aa, Homo sapiens; identical to SEQ ID NO: 739197

SEQ ID NO: 739200 - protein, 984 aa, Homo sapiens; identical to SEQ ID NO: 739197

SEQ ID NO: 739201 - protein, 943 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMILLSVRVFFKKCPSIVQNFAVFPETMTGAESTSLVIARGTCIPNAEEVDVPIKLYCNGDGEWMVPIGRCTCKPGYEPENSVACKACPAGRFKASQEAEGCSHCPSNSRSPAEASPICTCRTGYYRADFDPPEVACTSVPSGPRNVISIVNESSIILEWHPPRETGGRDDVTYNIICKKCRADGRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMASSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 739202 - protein, 943 aa, Homo sapiens; identical to SEQ ID NO: 739201

SEQ ID NO: 739203 - protein, 616 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMILLSVRVFFKKCPSIVQNFAVFPETMTGAESTSLVIARGTCIPNAEEVDVPIKLYCNGDGEWMVPIGRCTCKPGYEPENSVACKACPAGRFKASQEAEGCSHCPSNSRSPAEASPICTCRTGYYRADFDPPEVACTSVPSGPRNVISIVNESSIILEWHPPRETGGRDDVTYNIICKKCRADGRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMASSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDV

SEQ ID NO: 739204 - protein, 967 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKKSAFWSEAPYLKVDTIAADESFSQVDFGGRLMKVNTEVRSFGPLTRNGFYLAFQDYGACMILLSVRVFFKKCPSIVQNFAVFPETMTGAESTSLVIARGTCIPNAEEVDVPIKLYCNGDGEWMVPIGRCTCKPGYEPENSVACKACPAGRFKASQEAEGCSHCPSNSRSPAEASPICTCRTGYYRADFDPPEVACTSVPSGPRNVISIVNESSIILEWHPPRETGGRDDVTYNIICKKCRADGRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMASSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 739205 - protein, 962 aa, Homo sapiens
MDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMILLSVRVFFKKCPSIVQNFAVFPETMTGAESTSLVIARGTCIPNAEEVDVPIKLYCNGDGEWMVPIGRCTCKPGYEPENSVACKACPAGRFKASQEAEGCSHCPSNSRSPAEASPICTCRTGYYRADFDPPEVACTSVPSGPRNVISIVNESSIILEWHPPRETGGRDDVTYNIICKKCRADGRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMASSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 739206 - protein, 110 aa, Homo sapiens
MLSLLMSSSHRLGSLITSTTPTPPGEYNVIRSGVGLTGSRQTMFYTEVTDAQRSGPGGGLVEEGELIEVVHLPLEGAQAFADDPDIPKTLGVIFGVSWFLSQVAPNLDLQ

SEQ ID NO: 739207 - protein, 247 aa, Homo sapiens
SRARPKAPVGTGRRPVSAPACPGAAMERIEGASVGRCAASPYLRPLTLHYRQNGAQKSWDFMKTHDSVTVLLFNSSRRSLVLVKQFRPAVYAGEVERRFPGSLAAVDQDGPRELQPALPGSAGVTVELCAGLVDQPGLSLEEVACKEAWEECGYHLAPSDLRRVATYWSGVGLTGSRQTMFYTEVTDAQRSGPGGGLVEEGELIEVVHLPLEGAQAFADDPDIPKTLGVIFGVSWFLSQVAPNLDLQ

SEQ ID NO: 739208 - protein, 114 aa, Homo sapiens
PVTYIGEPARRPSQHVEGASGASVGDSADPVSTRRSGVGLTGSRQTMFYTEVTDAQRSGPGGGLVEEGELIEVVHLPLEGAQAFADDPDIPKTLGVIFGVSWFLSQVAPNLDLQ

SEQ ID NO: 739209 - protein, 253 aa, Homo sapiens
SRARPKAPVGTGRRPVSAPAELAAPACPGAAMERIEGASVGRCAASPYLRPLTLHYRQNGAQKSWDFMKTHDSVTVLLFNSSRRSLVLVKQFRPAVYAGEVERRFPGSLAAVDQDGPRELQPALPGSAGVTVELCAGLVDQPGLSLEEVACKEAWEECGYHLAPSDLRRVATYWSGVGLTGSRQTMFYTEVTDAQRSGPGGGLVEEGELIEVVHLPLEGAQAFADDPDIPKTLGVIFGVSWFLSQVAPNLDLQ

SEQ ID NO: 739210 - protein, 253 aa, Homo sapiens; identical to SEQ ID NO: 739209

SEQ ID NO: 739211 - protein, 205 aa, Homo sapiens
LEDLPRLARQNGAQKSWDFMKTHDSVTVLLFNSSRRSLVLVKQFRPAVYAGEVERRFPGSLAAVDQDGPRELQPALPGSAGVTVELCAGLVDQPGLSLEEVACKEAWEECGYHLAPSDLRRVATYWSGVGLTGSRQTMFYTEVTDAQRSGPGGGLVEEGELIEVVHLPLEGAQAFADDPDIPKTLGVIFGVSWFLSQVAPNLDLQ

SEQ ID NO: 739212 - protein, 104 aa, Homo sapiens
MGWGLAWASAAGHRLRGSKQHWEQPQGIWLGAADRGGVFCLALTGCRQVVSRICNLMGAWGLPGSRGYGRIQLLVAGDWVPPPCWLLALPSMAVASPSGPAGLA

SEQ ID NO: 739213 - protein, 168 aa, Homo sapiens
SRARPKAPVGTGRRPVSAPAELAAPACPGAAMERIEGASVGRCAASPYLRPLTLHYRQNGAQKSWDFMKTHDSLVLVKQFRPAVYAGEVERRFPGSLAAVDQDGPRELQPALPGSAGVTVELCAGLVDQPGLSLEEVACKEAWEECGYHLAPSDLRRVATYWDATMGS

SEQ ID NO: 739214 - protein, 100 aa, Homo sapiens
SRARPKAPVGTGRRPVSAPAELAAPACPGAAMERIEGASVGRCAASPYLRPLTLHYRQNGAQKSWDFMKTHDSVTVLLFNSSRRSLVLVKQFRPAVYAGD

SEQ ID NO: 739215 - protein, 450 aa, Homo sapiens
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSENEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKKLTAFPYSGKTRLSYQ

SEQ ID NO: 739216 - protein, 171 aa, Homo sapiens
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSENA

SEQ ID NO: 739217 - protein, 66 aa, Homo sapiens
MLALQEKGEELGNPWVSRRVVRLGNVLENLVSCVLLLIDLSGGTFMGNRDEKEKFLPKEYSFCFTS

SEQ ID NO: 739218 - protein, 81 aa, Homo sapiens
FTLEKGHMSVENVESVFVKRETSLNINEFTREKDIMNVENLADLLVKRAPSFNIREITLESTYEYGECAKSSSQKVGLIQQ

SEQ ID NO: 739219 - protein, 109 aa, Homo sapiens
FTLEKGHMSVENVESVFVKRETSLNINEFTREKDIMNVENLADLLVKRAPSFNIREITLESTYEYGECAKSSSAKKRCALTCEPIGRDPHVALKWLLLMLVEELLMTTP

SEQ ID NO: 739220 - protein, 104 aa, Homo sapiens
MPLPRSAFEDCDLHQEVLLTPVGKISPSFCLECPVFDLAAGVEPSPRPPGALPLWLSRNRMWLPWPNVVLLSPTPAPQLLSSSGPCVWLVFAGLSLCSGIALPL

SEQ ID NO: 739221 - protein, 104 aa, Homo sapiens; identical to SEQ ID NO: 739220

SEQ ID NO: 739222 - protein, 104 aa, Homo sapiens; identical to SEQ ID NO: 739220

SEQ ID NO: 739223 - protein, 71 aa, Homo sapiens
SRKKLGTCTGIEIDNPRCLCKSSSPRMLNFISKKKLPDVHRIIRVIMILELLYKSVLFAVDLSGLIQMYLW

SEQ ID NO: 739224 - protein, 164 aa, Homo sapiens
LLPPPQPLPPQRRGHVVWCVGRGEEEEGVKPREETGERHHTHGTRWPERQQHPELSGVPPRPRGPPAGGELRPDGQQARGSGAAAAEARRAARVGVTARGRGAQGGRAHDAESAAAVAASEAPPGPGGWTRRGREARAGGPARDSGLGDQEVPVAALGPGDLRD

SEQ ID NO: 739225 - protein, 164 aa, Homo sapiens; identical to SEQ ID NO: 739224

SEQ ID NO: 739226 - protein, 188 aa, Homo sapiens
LLPPPQPLPPQRRGHVVWCVGRGEEEEGVKPREETGERHHTHGTRWPERQQHPELSGVPPRPRGPPAGGELRPDGQQARGSGAAAAEARRAARVGVTARGRGAQGGRAHDAESAAAVAASEAPPGPGGWTRRGREARAGGPARDSGLGDQEVPVAALGPGSPTEELFNLFPVRWELIFMIEFKRTMEP

SEQ ID NO: 739227 - protein, 178 aa, Homo sapiens
LLPPPQPLPPQRRGHVVWCVGRGEEEEGVKPREETGERHHTHGTRWPERQQHPELSGVPPRPRGPPAGGELRPDGQQARGSGAAAAEARRAARVGVTARGRGAQGGRAHDAESAAAVAASEAPPGPGGWTRRGREARAGGPARDSGLGDQEVPVAALGPGSPTEELFNLFPPILKRLQ

SEQ ID NO: 739228 - protein, 164 aa, Homo sapiens; identical to SEQ ID NO: 739224

SEQ ID NO: 739229 - protein, 92 aa, Homo sapiens
NISAIEKQKLVYILNRDAAARLTISSPLEAHKANTLVYHVVGVDVGFEDPMFACLEMDYEEADNDPTGEAAANTQQTLDCISTNSDGELENL

SEQ ID NO: 739230 - protein, 164 aa, Homo sapiens; identical to SEQ ID NO: 739224

SEQ ID NO: 739231 - protein, 120 aa, Homo sapiens
RPRGPPAGGELRPDGQQARGSGAAAAEARRAARVGVTARGRGAQGGRAHDAESAAAVAASEAPPGPGGWTRRGREARAGGPARDSGLGDQEVPVAALGPGEWLPSSFYCPLSLGGKAKCP

SEQ ID NO: 739232 - protein, 143 aa, Homo sapiens
MRGSPREGGWPVEGLARIPDGRRKGGEPVKEADPKLRPGASSLMRGKPRSATILGSPFRRQRPPGHRGPPSHSAPPGHAAPAGRRGCPRHTVPRTETPPGHRGPPRHAVSRTQRSPQDTQCPQDTEVPQDTALPGHTAPPGHR

SEQ ID NO: 739233 - protein, 226 aa, Homo sapiens
MTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 739234 - protein, 290 aa, Homo sapiens
MWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 739235 - protein, 115 aa, Homo sapiens
CEKSGVTSETCFSSAAPPARDGPCSFPLRDVPGIHPGLSVRADFPTPVFATMIVTCSKLSFCSFAGHMHSFLPKTTPHHTAETVVTENMVCLPSLPFVGTSVASCCAPNKSKRPC

SEQ ID NO: 739236 - protein, 111 aa, Homo sapiens
MDGTRWDRHSHPLRAPKSNYLTEGRLCPWPHTGSSLSQWSAGLWYNARRPHVVPAPERAMGWGAELKTHRPLINTVASTCAALCQGPWSLPPMLLQPIWSSCPQPQHPIYL

SEQ ID NO: 739237 - protein, 211 aa, Homo sapiens
EGSRDQPGASMSRREGSLEDPQTDSSVSLLPHLEAKIRQTHSLAHLLTKYAEQLLQEYVQLQGDPFGLPSFSPPRLPVAGLSAPAPSHAGLPVHERLRLDAAALAALPPLLDAVCRRQAELNPRAPRLLRRLEDAARQARALGAAVEALLAALGAANRGPRAEPPAATASAASATGVFPAKVLGLRVCGLYREWLSRTEGDLGQLLPGGSA

SEQ ID NO: 739238 - protein, 110 aa, Homo sapiens [sequence omitted]

SEQ ID NO: 739239 - protein, 504 aa, Homo sapiens [sequence omitted]

SEQ ID NO: 739240 - protein, 504 aa, Homo sapiens [sequence omitted]

SEQ ID NO: 739241 - protein, 504 aa, Homo sapiens [sequence omitted]

SEQ ID NO: 739242 - protein, 482 aa, Homo sapiens
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPKCITALYVFAETHFDRGINDWLCKYVYNHIGGEHSAVIPELAATVATFAITTLWLGPCDIVYLWSFLNCFGLNFELWVQKLAEWGPLARIEASLSVQMSRRVRALFGAMNFWAIIMYNLVSLNSLKFTELVARRLLLTGEGQGCGDTEGARHQPQGP

SEQ ID NO: 739243 - protein, 427 aa, Homo sapiens
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPKCITALYVFAETHFDRGINDWLCKVRALFGAMNFWAIIMYNLVSLNSLKFTELVARRLLLTGFPQTTLSILFVTYCGVQLVKERERTLALEEEQKQDKEKPE

SEQ ID NO: 739244 - protein, 286 aa, Homo sapiens
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPMNFWAIIMYNLVSLNSLKFTELVARRLLLTGFPQTTLSILFVTYCGVQLVKERERTLALEEEQKQDKEKPE

SEQ ID NO: 739245 - protein, 121 aa, Homo sapiens
SLTVTDGTHTDFYVLPDTALATHKPQVMRVQIRSLDNRLPQITTNRGAPALKRLHTGHMGFLITSKSLKAEDQDSPHRLLKYKVTRGPEHGFIIKTGLGNQSTRVFTQADIDEMKISYVFE

SEQ ID NO: 739246 - protein, 121 aa, Homo sapiens
MGTWAMRNILPNHVTAETSLSRPPGQRPNSLTAGTSLPYPAGQQALPPRSLPPSPMITPACEWQLVLALSWFPPPQGFAGNKDVAAVTWLGRMFLMAQVPMERFTVIRVCKMAGGLRNGTG

SEQ ID NO: 739247 - protein, 115 aa, Homo sapiens [sequence omitted]

SEQ ID NO: 739248 - protein, 117 aa, Homo sapiens
LFAASCYIPAHSRPAAPLPARSVPRILPREPQTMGPIRVRTVVSAENAGALGCRKFFRSARPLFPARARERRFQFAWTCERAKAERSGERMCEPTSSSSRYPGLTERSACASLKPRG

SEQ ID NO: 739249 - protein, 126 aa, Homo sapiens
RELLPLISGASLKARWGRCSHAPAREIGHQRHRVSCLGSHSPQQQGLEPETGCSCSPAVPSCTSGASPPDSSDRNPLCIFILLLAQPALNRCDLGQECMKAGPVVLHAASWTGGPSVFVSVVMRRA

SEQ ID NO: 739250 - protein, 126 aa, Homo sapiens
FLEDPGLTKSPASAGDHVGRLGSSRSVTSLGHTLVESALTRPSLPSPHRTSPRVEESNSKLLESERKLQEERHRTVVLEQHLEKIRLEPGKASASQRAAPRTKTAPFLGCMLCYGALAVDAQWGLG

SEQ ID NO: 739251 - protein, 259 aa, Homo sapiens
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDYAMLVTMFGWFTMVISYVVYYVRQNQEDARRHLEYLKSLPSRQKKADEPDDISTVV

SEQ ID NO: 739252 - protein, 259 aa, Homo sapiens; identical to SEQ ID NO: 739251

SEQ ID NO: 739253 - protein, 259 aa, Homo sapiens; identical to SEQ ID NO: 739251

SEQ ID NO: 739254 - protein, 67 aa, Homo sapiens
DVRKESESPGDRISAKNIYTMEYCAAIKRNEFMSFAGTWMKLETIILSKLTQQQKTKHRMFSLISGS

SEQ ID NO: 739255 - protein, 109 aa, Homo sapiens
MPQFSLEQSTLGPYSAPSPAYSSSSLYAPDAVASSGPIISDITVRAPASPMASPGGSIDERPLSSIPCKYLLGAMGRGLGGGRWGNPLPWPCLPFLPRAPSYFFFFNTM

SEQ ID NO: 739256 - protein, 183 aa, Homo sapiens
MIKLFSLKQQKKEEESAGGTKGSSKKASAAQLRIQKDINELNLPKTCDISFSDPDDLLNFKLVICPDEGFYKSGKFVFSFKVGQGYPHDPPKVKCETMVYHPNIDLEGNVCLNILREDWKPVLTINSIIYGLQYLFLEPNPEDPLNKEAAEVLQNNRRLFEQNVQRSMRGGYIGSTYFERCLK

SEQ ID NO: 739257 - protein, 183 aa, Homo sapiens; identical to SEQ ID NO: 739256

SEQ ID NO: 739258 - protein, 183 aa, Homo sapiens; identical to SEQ ID NO: 739256

SEQ ID NO: 739259 - protein, 183 aa, Homo sapiens; identical to SEQ ID NO: 739256

SEQ ID NO: 739260 - protein, 261 aa, Homo sapiens
SGGEPKRAGGGNIRSGGAPEAVADLRAKAAAAAEDDPPVPARRHRSCRVLLPPLAAPPRGGISLAAKRHGRGSPESAAAAGPETRVGQKKEEESAGGTKGSSKKASAAQLRIQKDINELNLPKTCDISFSDPDDLLNFKLVICPDEGFYKSGKFVFSFKVGQGYPHDPPKVKCETMVYHPNIDLEGNVCLNILREDWKPVLTINSIIYGLQYLFLEPNPEDPLNKEAAEVLQNNRRLFEQNVQRSMRGGYIGSTYFERCLK

SEQ ID NO: 739261 - protein, 116 aa, Homo sapiens
MIKLFSLKQQKKEEESAGGTKGSSKKASAAQLRIQKDINELNLPKTCDISFSDPDDLLNFKLVICPDEGFYKSGKFVFSFKVGQGYPHDPPKVKCETMVYHPNIDLEGNVCLNILR

SEQ ID NO: 739262 - protein, 102 aa, Homo sapiens
MLSVHREDWKPVLTINSIIYGLQYLFLVSRNEVVGSGEIGLLSLWPVDPPYLYWPQEPNPEDPLNKEAAEVLQNNRRLFEQNVQRSMRGGYIGSTYFERCLK

SEQ ID NO: 739263 - protein, 183 aa, Homo sapiens; identical to SEQ ID NO: 739256

SEQ ID NO: 739264 - protein, 183 aa, Homo sapiens; identical to SEQ ID NO: 739256

SEQ ID NO: 739265 - protein, 183 aa, Homo sapiens; identical to SEQ ID NO: 739256

SEQ ID NO: 739266 - protein, 182 aa, Homo sapiens
MNGQDGSLAVLLVHPMCAMHAMNGCRRAQLAGSMKDINELNLPKTCDISFSDPDDLLNFKLVICPDEGFYKSGKFVFSFKVGQGYPHDPPKVKCETMVYHPNIDLEGNVCLNILREDWKPVLTINSIIYGLQYLFLEPNPEDPLNKEAAEVLQNNRRLFEQNVQRSMRGGYIGSTYFERCLK

SEQ ID NO: 739267 - protein, 160 aa, Homo sapiens
MIKLFSLKQQKKEEESAGGTKGSSKKASAAQLRIQKDINELNLPKTCDISFSDPDDLLNFKLVICPDEVRVHMAEFPGANQGCPHSEEGDMFCPSGPTGWNPKIFFSPFSSQGFYKSGKFVFSFKVGQGYPHDPPKVKCETMVYHPNIDLEGNVCLNILR

SEQ ID NO: 739268 - protein, 361 aa, Homo sapiens
GVTAPRATQQAEDPRESPSTLWGHVGPSIPACLRVRRQSWWPGKPRSASAEPLRRVAVTGGTHGNEMSGVYLARHWLHAPAELQRASFSAVPVLANPAATSGCRRYVDHDLNRTFTSSFLNSRPTPDDPYEVTRARELNQLLGPKASGQAFDFVLDLHNTTANMGTCLIAKSSHEVFAMHLCRHLQLQYPELSCQVFLYQRSGEESYNLDSVAKNGLGLELGPQPQGVLRADIFSRMRTLVATVLDFIELFNQGTAFPAFEMEAYRPVGVVDFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 739269 - protein, 319 aa, Homo sapiens
MCSLPVPREPLRRVAVTGGTHGNEMSGVYLARHWLHAPAELQRASFSAVPVLANPAATSGCRRYVDHDLNRTFTSSFLNSRPTPDDPYEVTRARELNQLLGPKASGQAFDFVLDLHNTTANMGTCLIAKSSHEVFAMHLCRHLQLQYPELSCQVFLYQRSGEESYNLDSVAKNGLGLELGPQPQGVLRADIFSRMRTLVATVLDFIELFNQGTAFPAFEMEAYRPVGVVDFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 739270 - protein, 135 aa, Homo sapiens
MATRCRASTWPGTGCMPPQSCREPASPLCLCWPTRQPHPAAAATWNFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 739271 - protein, 77 aa, Homo sapiens
ARKYSNWKETCNCPVDISNTLNFAISSHRHQMDTKVIQTVSAMDKDDPKNGHYFLYSLLPEMVNNPNFTIKKNEGMP

SEQ ID NO: 739272 - protein, 83 aa, Homo sapiens
ARKYSNWKETCNCPVDISNTLNFAISSHRHQMDTKVIQTVSAMDKDDPKNGHYFLYSLLPEMVNNPNFTIKKNEDQKSMSFAS

SEQ ID NO: 739273 - protein, 800 aa, Homo sapiens
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHQKNEPLIIKDDEDVRENIIRYDDEGGGEEDTEAFDIATLQNPDGINGFLPRKDIKPDLQFMPRQGLAPVPNGVDVDEFINVRLHEADNDPTAPPYDSIQIYGYEGRGSVAGSLSSLESTTSDSDQNFDYLSDWGPRFKRLGELYSVGESDKET

SEQ ID NO: 739274 - protein, 532 aa, Homo sapiens
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVNISMLLMLNMFVYNCLIFD

SEQ ID NO: 739275 - protein, 321 aa, Homo sapiens
PKYQTTKRMSLSFYRWQEPLKSSEMLTSSFMFQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHQKNEPLIIKDDEDVRENIIRYDDEGGGEEDTEAFDIATLQNPDGINGFLPRKDIKPDLQFMPRQGLAPVPNGVDVDEFINVRLHEADNDPTAPPYDSIQIYGYEGRGSVAGSLSSLESTTSDSDQNFDYLSDWGPRFKRLGELYSVGESDKET

SEQ ID NO: 739276 - protein, 286 aa, Homo sapiens
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSKLISCTG

SEQ ID NO: 739277 - protein, 198 aa, Homo sapiens
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGMYASNFTDLLKVIFR

SEQ ID NO: 739278 - protein, 185 aa, Homo sapiens
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 739279 - protein, 185 aa, Homo sapiens; identical to SEQ ID NO: 739278

SEQ ID NO: 739280 - protein, 214 aa, Homo sapiens
TYVIVRGRVVTLPALAAGSTFPVLACSSAMAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 739281 - protein, 185 aa, Homo sapiens; identical to SEQ ID NO: 739278

SEQ ID NO: 739282 - protein, 185 aa, Homo sapiens; identical to SEQ ID NO: 739278

SEQ ID NO: 739283 - protein, 187 aa, Homo sapiens
TSSSDPDFTKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 739284 - protein, 189 aa, Homo sapiens
RLGSEAGWCQPKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 739285 - protein, 198 aa, Homo sapiens
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERFDSCLKYGHHKRGILWKKNEVADYEATTFSIFYNNTLFLVVVIVASFFILKNFNPTVNYILSISASSGLIALLSTGSK

SEQ ID NO: 739286 - protein, 106 aa, Homo sapiens
AAAYYYYCSEFKLLTMYGELHPLALCLWVACGIWKSSRVVRVGDTRCFYSLEPLKNPAECNSVFVYWLFFDRLLKLNELKGKLRVLGRLLKGKKCLAMCCNHKRRK

SEQ ID NO: 739287 - protein, 185 aa, Homo sapiens; identical to SEQ ID NO: 739278

SEQ ID NO: 739288 - protein, 169 aa, Homo sapiens
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVYPFQG

SEQ ID NO: 739289 - protein, 92 aa, Homo sapiens
ACSSAMAPKGSSKQQSEEDLLLQDFSRNLSAKSSALFFGNAFIVSAIPICECWERGGLGRPPASRAGRGRGRTRRAGKAWVPAGGRQSLQLP

SEQ ID NO: 739290 - protein, 185 aa, Homo sapiens; identical to SEQ ID NO: 739278

SEQ ID NO: 739291 - protein, 185 aa, Homo sapiens; identical to SEQ ID NO: 739278

SEQ ID NO: 739292 - protein, 185 aa, Homo sapiens; identical to SEQ ID NO: 739278

SEQ ID NO: 739293 - protein, 185 aa, Homo sapiens; identical to SEQ ID NO: 739278

SEQ ID NO: 739294 - protein, 185 aa, Homo sapiens; identical to SEQ ID NO: 739278

SEQ ID NO: 739295 - protein, 183 aa, Homo sapiens
IGEGSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 739296 - protein, 230 aa, Homo sapiens
LNSTPPSRPPQVKTATIATERNGKPENHTMNINASIYDEIQQEMKRAKVSQALFAKVAATKSQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 739297 - protein, 122 aa, Homo sapiens
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERTS

SEQ ID NO: 739298 - protein, 503 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739299 - protein, 474 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739300 - protein, 531 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGERGRGWEAWGQGEARDEVPAQDSLPDAGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739301 - protein, 516 aa, Homo sapiens
MPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739302 - protein, 577 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGVGVPGEGGSAGGASAPGRTLEKGAGDWGAGELGGDHRSHCPPLLRPRAPCWGAVRVGSRDDPQPRAPARGTNDRLRGVGVGRPGAQGEARDEVPAQDSLPDAGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739303 - protein, 516 aa, Homo sapiens; identical to SEQ ID NO: 739301

SEQ ID NO: 739304 - protein, 474 aa, Homo sapiens; identical to SEQ ID NO: 739299

SEQ ID NO: 739305 - protein, 210 aa, Homo sapiens
MYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739306 - protein, 210 aa, Homo sapiens; identical to SEQ ID NO: 739305

SEQ ID NO: 739307 - protein, 210 aa, Homo sapiens; identical to SEQ ID NO: 739305

SEQ ID NO: 739308 - protein, 572 aa, Homo sapiens
MPVPERPAAGPDSPRPGTRRAAPRVLFGEWLLGEISSGCYEGLQWLDEARTCFRVPWKHFARKDLSEADARIFKVGTPAPPRPGWESPPRTPRARQHVFCPPLQAWAVARGRWPPSSRGGGPPPEAETAERAGWKTNFRCALRSTRRFVMLRDNSGDPADPHKVYALSRELCWREGPGTDQTEAEAPAAVPPPQGTLLSACLSSCQAAELLTFTLTFALQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739309 - protein, 559 aa, Homo sapiens
MALAPERAAPRVLFGEWLLGEISSGCYEGLQWLDEARTCFRVPWKHFARKDLSEADARIFKVGTPAPPRPGWESPPRTPRARHTCSVPLFQAWAVARGRWPPSSRGGGPPPEAETAERAGWKTNFRCALRSTRRFVMLRDNSGDPADPHKVYALSRELCWREGPGTDQTEAEAPAAVPPPQGTLLSACLSSCQAAELLTFTLTFALQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739310 - protein, 530 aa, Homo sapiens
WYWPEVSLAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGTLLSACLSSCQAAELLTFTLTFALQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739311 - protein, 431 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLEWADPQAPPAPPPQPACCLGTVTPPSSTSESSSKSWWNSGHGSAVAPHAIPSTWASGRTCQLGGPRRRAWSW

SEQ ID NO: 739312 - protein, 442 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGERGRGWEAWGQGEARDEVPAQDSLPDAGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQGQ

SEQ ID NO: 739313 - protein, 490 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGERGRGWEAWGQGEARDEVPAQDSLPDAGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739314 - protein, 461 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGERGRGWEAWGQGEARDEVPAQDSLPDAGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLSWWNSGHGSAVAPHAIPSTWASGRTCQLGGPRRRAWSW

SEQ ID NO: 739315 - protein, 339 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 739316 - protein, 280 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAGQLGGPRRRAWSW

SEQ ID NO: 739317 - protein, 264 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTASAPRGHAA

SEQ ID NO: 739318 - protein, 222 aa, Homo sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGTLLSACLSSCQAAELLTFTLTFPCRVGPQGHSWHTHMLDSKPQAPSLPQLVTRGTSCSRQCNRAAWQTIC

SEQ ID NO: 739319 - protein, 180 aa, Homo sapiens
IRHEDEARTCFRVPWKHFARKDLSEADARIFKAWAVARGRWPPSSRGGGPPPEAETAEPPAVTPVAPSAKRSIPRQRRWLQALSPHLWTPVTPGHTTCGRGLASAATGALTSPVITPDRHLTAPAEGAMALAPERAAPRVLFGEWLLGEISSGCYEGLQCWSSPPRTQSNENSRKLEQPT

SEQ ID NO: 739320 - protein, 112 aa, Homo sapiens
MALHLQTQHIHIRSHSSHHPSYPTPHEDNIRTSIDPLAHPSRYFTQQESFAHDRIYKLIIPTFDIKQIDSQSIDNIYIETCATRQPTEKDTSYSLSQHNAPLKNRQIHRQSY

SEQ ID NO: 739321 - protein, 120 aa, Homo sapiens
AGGIPGTAAPWLPTLYHLPGLRAGPVSWEAQGEEPGPGEGETRASRRGGHVLRPTDRRLMPSEPRRGGGEAIHRVTDRRPTPSEPGEGEGRTHAGSLTDARSLLAAGTLAVPSAPRGHAA

SEQ ID NO: 739322 - protein, 116 aa, Homo sapiens
LSVLILTCKSKLVVAFKGQVPAYYGSRHMVVFFFPPNSLIQIGSCTHQMGQIAIVSFQNSTPKVIECFNVESRILCMLYVPVEEKRREPGAPPDPETPAVRASDVPTICVGTEEGR

SEQ ID NO: 739323 - protein, 1335 aa, Homo sapiens
LLAGAPSLNRAERGIWSCSMDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 739324 - protein, 775 aa, Homo sapiens
ICQATFQLDAYITTCLQQYSEFMWAFPYSLKALAHREMLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 739325 - protein, 289 aa, Homo sapiens
WIICLGTKSQVSDADSFAIGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 739326 - protein, 1066 aa, Homo sapiens
MCIFLSAELLRIFRPSFVTVNDCGCIKNKFNIFKAWRLFVSKKPGKIKKHLSCVTDKRVRETLIFWEFEECHFHSLKVLVSVTALKIYKSVCIFLLVLVLEYLYHPPIHPPTHISIIHRPSTCLSSVHHFSLSNFQNILYSLYKGRFFFSVKFSKADKLPGMTVADAHSQVVLGVQMGQGHLWKHLKCFSPASPALPGGGGAARCLPWSKPGAPQGPQHDSDFLPPPALDDLVKPQTGTKQPTWNSKVFNFILEFMHSDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWVRCVYLVLVQVHRESTFMVGVMRELRCELLSRELAVAYPRVYLETENFFERELITFGKDLQFLGMQIFVSFPFHLKHLPDKVESRDNYTNEENNFNMFFHFGVNIAWIFFLVPRLAFSSGNLAVKINLFQMKYCI

SEQ ID NO: 739327 - protein, 1376 aa, Homo sapiens
MCIFLSAELLRIFRPSFVTVNDCGCIKNKFNIFKAWRLFVSKKPGKIKKHLSCVTDKRVRETLIFWEFEECHFHSLKVLVSVTALKIYKSVCIFLLVLVLEYLYHPPIHPPTHISIIHRPSTCLSSVHHFSLSNFQNILYSLYKGRFFFSVKFSKADKLPGMTVADAHSQVVLGVQMGQGHLWKHLKCFSPASPALPGGGGAARCLPWSKPGAPQGPQHDSDFLPPPALDDLVKPQTGTKQPTWNSKVFNFILEFMHSDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 739328 - protein, 1347 aa, Homo sapiens
MCIFLSAELLRIFRPSFVTVNDCGCIKNKFNIFKAWRLFVSKKPGKIKKHLSCVTDKRVRETLIFWEFEECHFHSLKVLVSVTALKIYKSVCIFLLVLVLEYLYHPPIHPPTHISIIHRPSTCLSSVHHFSLSNFQNILYSLYKGRFFFSVKFSKADKLPGMTVADAHSQVVLGVQMGQGHLWKHLKCFSPASPALPGGGGAARCLPWSKPGAPQGPQHDSDFLPPPALDDLVKPQTGTKQPTWNSKVFNFILEFMHSDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 739329 - protein, 1272 aa, Homo sapiens
GVVPASQFGSVPLGSHGVSSGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 739330 - protein, 1335 aa, Homo sapiens
MCIFLSAELLRIFRPSFVTVNDCGCIKNKFNIFKAWRLFVSKKPGKIKKHLSCVTDKRVRETLIFWEFEECHFHSLKVLVSVTALKIYKSVCIFLLVLVLEYLYHPPIHPPTHISIIHRPSTCLSSVHHFSLSNFQNILYSLYKGRFFFSVKFSKADKLPGMTVADAHSQVVLGVQMGQGHLWKHLKCFSPASPALPGGGGAARCLPWSKPGAPQGPQHDSDFLPPPALDDLVKPQTGTKQPTWNSKVFNFILEFMHSDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 739331 - protein, 458 aa, Homo sapiens
MVVFFFPPNSLIQIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 739332 - protein, 292 aa, Homo sapiens
LLAGAPSLNRAERGIWSCSMDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPGLILSGIDLRRFSSAAFPSGCQSDYLVDGPDVFCIHVLYVASRMAY

SEQ ID NO: 739333 - protein, 135 aa, Homo sapiens [sequence omitted]

SEQ ID NO: 739334 - protein, 114 aa, Homo sapiens
MGPQEAVPFTGPPRTPIQEEDFWSTPFSHAHPLPFFFSKPLRILNILLLLEGAVIVYQLYSLMSSEKWHQTISLALILFSNYYAFFKLLRDRLVLGKAYSYSASPQRDLDHRFS

SEQ ID NO: 739335 - protein, 492 aa, Homo sapiens
MGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLNFHLIDFNLLMVTTIVLGRRFIGSIVKEASQRGKVSLFRSILLFLTRFTVLTATGWSLCRSLIHLFRTYSFLNLLFLCYPFGMYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHFFFSKPLRILNILLLLEGAVIVYQLYSLMSSEKWHQTISLALILFSNYYAFFKLLRDRLVLGKAYSYSASPQRDLDHRFS

SEQ ID NO: 739336 - protein, 293 aa, Homo sapiens
MYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHFFFSKPLRILNILLLLEGAVIVYQLYSLMSSEKWHQTISLALILFSNYYAFFKLLRDRLVLGKAYSYSASPQRDLDHRFS

SEQ ID NO: 739337 - protein, 508 aa, Homo sapiens
MGEQSGSGSAWQQSGRTGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLNFHLIDFNLLMVTTIVLGRRFIGSIVKEASQRGKVSLFRSILLFLTRFTVLTATGWSLCRSLIHLFRTYSFLNLLFLCYPFGMYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHFFFSKPLRILNILLLLEGAVIVYQLYSLMSSEKWHQTISLALILFSNYYAFFKLLRDRLVLGKAYSYSASPQRDLDHRFS

SEQ ID NO: 739338 - protein, 430 aa, Homo sapiens
MGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLNFHLIDFNLLMVTTIVLGRRFIGSIVKEASQRGKVSLFRSILLFLTRFTVLTATGWSLCRSLIHLFRTYSFLNLLFLCYPFGMYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHVSLLPGEGGLGPERVGGS

SEQ ID NO: 739339 - protein, 77 aa, Homo sapiens
EAHILLQFLWVKSVEVAKQNESSSESHESANQAIFWGCNHLKAQLGLKNALCSSLFAWLRRSISRLTYTGRPQFLAM

SEQ ID NO: 739340 - protein, 88 aa, Homo sapiens
MHRCREGCDLLRVLCGMLVLCGSWPPPLPAQKAQLPSEFRRMICRERRTTWRVWSSTSAQYDVENCLANKVDLSFSPSQSLPADPMQS

SEQ ID NO: 739341 - protein, 82 aa, Homo sapiens
MALTHTPLGLIDLSWSILKPIPGEKGTGLLWLALVGFGQSCIICQDWVLSCPNKSGFCWQAKKRVAAGRQPTVSATDGKTQR

SEQ ID NO: 739342 - protein, 111 aa, Homo sapiens [sequence omitted]

SEQ ID NO: 739343 - protein, 61 aa, Homo sapiens
MGYSLGEEKRVGDGFLGLGPHRPPPSTHGDRWVITVRGPGAANLHVRHPRKAVGPLLLSPK

SEQ ID NO: 739344 - protein, 106 aa, Homo sapiens
TAGNVWRHFWRWRVVRGTTSINGWRPGMRLNTQPSWISLPGLPSQDTADGEAYTTEMCILRILEAGSPRSVGFLLRPLSLASTHGVLAWSFLCVHMTVQDWCPDFL

SEQ ID NO: 739345 - protein, 386 aa, Homo sapiens
VREFGGGRLCRDAMYRLLSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRAR

SEQ ID NO: 739346 - protein, 560 aa, Homo sapiens
VREFGGGRLCRDAMYRLLSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRARFYVYNKKKRLVNTPYVDNSYKWAGGGFLSTVGDLLKFGNAMLYGYQVGLFKNSNENLLPGYLKPETMVMMWTPVPNTEMSWDKEGKYAMAWGVVEKKQTYGSCRKQRHYASHTGGAVGASSVLLVLPEELDTETINNKVPPRGIIVSIICNMQSVGLNSTALKIALEFDKDRSD

SEQ ID NO: 739347 - protein, 388 aa, Homo sapiens [sequence omitted]

SEQ ID NO: 739348 - protein, 233 aa, Homo sapiens
MSQGSQFLYSTFGYTLLAAIVERASGCKYLDYMQKIFHDLDMLTTVQEENEPVIYNRARFYVYNKKKRLVNTPYVDNSYKWAGGGFLSTVGDLLKFGNAMLYGYQVGLFKNSNENLLPGYLKPETMVMMWTPVPNTEMSWDKEGKYAMAWGVVEKKQTYGSCRKQRHYASHTGGAVGASSVLLVLPEELDTETINNKVPPRGIIVSIICNMQSVGLNSTALKIALEFDKDRSD

SEQ ID NO: 739349 - protein, 193 aa, Homo sapiens [sequence omitted]

SEQ ID NO: 739350 - protein, 141 aa, Homo sapiens
AVVYYYKIRGRVDVGLFKNSNENLLPGYLKPETMVMMWTPVPNTEMSWDKEGKYAMAWGVVEKKQTYGSCRKQRHYASHTGGAVGASSVLLVLPEELDTETINNKVPPRGIIVSIICNMQSVGLNSTALKIALEFDKDRSD

SEQ ID NO: 739351 - protein, 386 aa, Homo sapiens; identical to SEQ ID NO: 739345

SEQ ID NO: 739352 - protein, 346 aa, Homo sapiens
VREFGGGRLCRDAMYRLLSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSHFCIHYTHELTDSH

SEQ ID NO: 739353 - protein, 109 aa, Homo sapiens [sequence omitted]

SEQ ID NO: 739354 - protein, 109 aa, Homo sapiens [sequence omitted]

SEQ ID NO: 739355 - protein, 466 aa, Homo sapiens
CACVRHGERKRKVECVGWAPQQPVAMRGLEEPGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEGGAIYLSGIDMIHGTPVLDIKPYIAEYDSPQNVMEPLADFNLQNNQHTPNTVSQSDSKTDSCDQRQLSGCDEPQPHHSTKRKPKCPEDRTSEENYLTHSDTARIQQAFPMHREIAVDFGLESRRDQSSSVAEEQIGPYCPEKSFSEKGTDKKLERVEGAAVLQGSRAETQPMAPHCPAGRADGAPRSVVPAWVTEAPVATLEVRFTPHAEMDLGQLSSQDVGQASFKYFQSAEEAKRAIEAVLSADPRSVYRRKLCQDRLFYFTVDIAHVTCWFGDGFAEVLRIKPASEPVHMTGPVGSLVSLGS

SEQ ID NO: 739356 - protein, 466 aa, Homo sapiens; identical to SEQ ID NO: 739355

SEQ ID NO: 739357 - protein, 295 aa, Homo sapiens [sequence omitted]

SEQ ID NO: 739358 - protein, 295 aa, Homo sapiens [sequence omitted]

SEQ ID NO: 739359 - protein, 391 aa, Homo sapiens
CACVRHGERKRKVECVGWAPQQPVAMRGLEEPGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEGGAIYLSGIDMIHGTPVLDIKPYIAEYDSPQNVMEPLADFNLQNNQHTPNTVSQSDSKTDSCDQRQLSGCDEPQPHHSTKRKPKCPEDRTSEENYLTHSDTARIQQAFPMHREIAVDFGLESRRDQSSSVAEEQIGPYCPEKSFSEKGTDKKLERVEGAAVLQGSRAETQPMAPHCPAGRADGAPRSVVPAWVTEAPVATLEVRFTPHAEMDLGQLSSQGIFSFFILNER

SEQ ID NO: 739360 - protein, 500 aa, Homo sapiens
CACVRHGERKRKVECVGWAPQQPVAMRGLEEPGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEALGKWTDIMAAVLMSTVLCGGVWDESHYKDKHWSGGAIYLSGIDMIHGTPVLDIKPYIAEYDSPQNVMEPLADFNLQNNQHTPNTVSQSDSKTDSCDQRQLSGCDEPQPHHSTKRKPKCPEDRTSEENYLTHSDTARIQQAFPMHREIAVDFGLESRRDQSSSVAEEQIGPYCPEKSFSEKGTDKKLERVEGAAVLQGSRAETQPMAPHCPAGRADGAPRSVVPAWVTEAPVATLEVRFTPHAEMDLGQLSSQDVGQASFKYFQSAEEAKRAIEAVLSADPRSVYRRKLCQDRLFYFTVDIAHVTCWFGDGFAEVLRIKPASEPVHMTGPVGSLVSLGS

SEQ ID NO: 739361 - protein, 394 aa, Homo sapiens [sequence omitted]

SEQ ID NO: 739362 - protein, 428 aa, Homo sapiens
MRRVGTSATSSHARLGGAGASAYSDPVRLREAGSGDRILFVFHKNGHLSCKAKVQPPRLNGAKTGVFSTRSPHRPNAIGLTLAKLEKVEALGKWTDIMAAVLMSTVLCGGVWDESHYKDKHWSGGAIYLSGIDMIHGTPVLDIKPYIAEYDSPQNVMEPLADFNLQNNQHTPNTVSQSDSKTDSCDQRQLSGCDEPQPHHSTKRKPKCPEDRTSEENYLTHSDTARIQQAFPMHREIAVDFGLESRRDQSSSVAEEQIGPYCPEKSFSEKGTDKKLERVEGAAVLQGSRAETQPMAPHCPAGRADGAPRSVVPAWVTEAPVATLEVRFTPHAEMDLGQLSSQDVGQASFKYFQSAEEAKRAIEAVLSADPRSVYRRKLCQDRLFYFTVDIAHVTCWFGDGFAEVLRIKPASEPVHMTGPVGSLVSLGS

SEQ ID NO: 739363 - protein, 267 aa, Homo sapiens
ESSSCTFQATPNTVSQSDSKTDSCDQRQLSGCDEPQPHHSTKRKPKCPEDRTSEENYLTHSDTARIQQAFPMHREIAVDFGLESRRDQSSSVAEEQIGPYCPEKSFSEKGTDKKLERVEGAAVLQGSRAETQPMAPHCPAGRADGAPRSVVPAWVTEAPVATLEVRFTPHAEMDLGQLSSQDVGQASFKYFQSAEEAKRAIEAVLSADPRSVYRRKLCQDRLFYFTVDIAHVTCWFGDGFAEVLRIKPASEPVHMTGPVGSLVSLGS

SEQ ID NO: 739364 - protein, 158 aa, Homo sapiens
YPFSEKLFSGLVWANMFFCHAGNSDHVLIPNQNPLLSPRSVVPAWVTEAPVATLEVRFTPHAEMDLGQLSSQDVGQASFKYFQSAEEAKRAIEAVLSADPRSVYRRKLCQDRLFYFTVDIAHVTCWFGDGFAEVLRIKPASEPVHMTGPVGSLVSLGS

SEQ ID NO: 739365 - protein, 122 aa, Homo sapiens
WVRGGRKLGKGVCPPPPHRAARVLGGPGDGNPGACRGRAPSPVSRADRPAIGGAEPGRGGPPVVRFRNRTRSRSVSPRRRGGASAAVGFRRGLGPALGDKESAWGRGGDAAVLAPHVPPPRT

SEQ ID NO: 739366 - protein, 97 aa, Homo sapiens
TFSSKEIITKHLGPDFCKAVLAGGSGIRAHSPGDRAVHFQKGRKGSAQKHAQTVSSPAARLLRPSRLLSPQVPPQSMSLGYECHLVSVRSPPHCSCQ

SEQ ID NO: 739367 - protein, 97 aa, Homo sapiens; identical to SEQ ID NO: 739366

SEQ ID NO: 739368 - protein, 98 aa, Homo sapiens
SSVAAQPGHASFSAGAGILVARILASLSRLLLSLPPPPATESLCPDPAPAGVCGWGSTPFWFLVAMDLTLWQDSCCPLLQGGWQNGTSTAPDTMNPGL

SEQ ID NO: 739369 - protein, 359 aa, Homo sapiens
ASAGWCGGGTAPEPERTRAELEKLIQQRAVLRVSYKGSISYRNAARVQPPRRGATPPAPPRAPGGAARPVSLREVVRYLGGSGGAGGRLTRGRVQGLLEEEAAARGRLERTRLGALALPRGDRPGRAPPAASARPSRSKRGGEERVLEKEEEEDDDEDEDEEDDVSEGSEVPESDRPAGAQHHQLNGERGPQSAKERVKEWTPCGPHQGQDEGRGPAPGSGTRQVFSMAAMNKEGGTASVATGPDSPSPVPLPPGKPALPGADGTPFGCPPGRKEKPSDPVEWTVMDVVEYFTEAGFPEQATAFQEQEIDGKSLLLMQRTDVLTGLSIRLGPALKIYEHHIKVLQQGHFEDDDPDGFLG

SEQ ID NO: 739370 - protein, 359 aa, Homo sapiens; identical to SEQ ID NO: 739369

SEQ ID NO: 739371 - protein, 132 aa, Homo sapiens
MAAMNKEGGTASVATGPDSPSPVPLPPGKPALPGADGTPFGCPPGRKEKPSDPVEWTVMDVVEYFTEAGFPEQATAFQEQEIDGKSLLLMQRTDVLTGLSIRLGPALKIYEHHIKVLQQGHFEDDDPDGFLG

SEQ ID NO: 739372 - protein, 297 aa, Homo sapiens
SGGSRGGGRRAGREAARTVQPGRAGGMAGPPALSPPETAAAATTAADRRSSSAASPHYQEWILDTIDSPAPARLSSKRGGEERVLEKEEEEDDDEDEDEEDDVSEGSEVPESDRPAGAQHHQLNGERGPQSAKERVKEWTPCGPHQGQDEGRGPAPGSGTRQVFSMAAMNKEGGTASVATGPDSPSPVPLPPGKPALPGADGTPFGCPPGRKEKPSDPVEWTVMDVVEYFTEAGFPEQATAFQEQEIDGKSLLLMQRTDVLTGLSIRLGPALKIYEHHIKVLQQGHFEDDDPDGFLG

SEQ ID NO: 739373 - protein, 267 aa, Homo sapiens
DGVGRPTRRAAARGRLERTRLGALALPRGDRPGRAPPAASARPSRSKRGGEERVLEKEEEEDDDEDEDEEDDVSEGSEVPESDRPAGAQHHQLNGERGPQSAKERVKEWTPCGPHQGQDEGRGPAPGSGTRQVFSMAAMNKEGGTASVATGPDSPSPVPLPPGKPALPGADGTPFGCPPGRKEKPSDPVEWTVMDVVEYFTEAGFPEQATAFQEQEIDGKSLLLMQRTDVLTGLSIRLGPALKIYEHHIKVLQQGHFEDDDPDGFLG

SEQ ID NO: 739374 - protein, 359 aa, Homo sapiens; identical to SEQ ID NO: 739369

SEQ ID NO: 739375 - protein, 232 aa, Homo sapiens
ASAGWCGGGTAPEPERTRAELEKLIQQRAVLRVSYKGSISYRNAARVQPPRRGATPPAPPRAPGGAARPVSLREVVRYLGGSGGAGGRLTRGRVQGLLEEEAAARGRLERTRLGALALPRGDRPGRAPPAASARPSRSKRGGEERVLEKEEEEDDDEDEDEEDDVSEGSEVPESDRPAGAQHHQLNGERGPQSAKERVKEWTPCGPHQGQDEGRGPAPGSGTRQVFSQMFPV

SEQ ID NO: 739376 - protein, 301 aa, Homo sapiens
AALPPARPPGALLLRLLVALVSLSPPSATGSLSVSFPIVAWLSRSPGLAVLLCLPLSSAAVLCAVPHLACRMKNPMLEVVSLLLEKLLLISNFTLFSSGAAGKDKGRNSFYETSSFHRGDVLEVPRTHLTHYGIYLGDNRVAHMMPDILLALTDDMGRTQKVVSNKRLILGVIVKVASIRVDTVEDFAYGANILVNHLDESLQKKALLNEEVARRAEKLLGFTPYSLLWNNCEHFVTYCRYGTPISPQSDKFCETVKIIIRDQRSVLASAVLGLASIVCTGLVSYTTLPAIFIPFFLWMAG

SEQ ID NO: 739377 - protein, 230 aa, Homo sapiens
MKNPMLEVVSLLLEKLLLISNFTLFSSGAAGKDKGRNSFYETSSFHRGDVLEVPRTHLTHYGIYLGDNRVAHMMPDILLALTDDMGRTQKVVSNKRLILGVIVKVASIRVDTVEDFAYGANILVNHLDESLQKKALLNEEVARRAEKLLGFTPYSLLWNNCEHFVTYCRYGTPISPQSDKFCETVKIIIRDQRSVLASAVLGLASIVCTGLVSYTTLPAIFIPFFLWMAG

SEQ ID NO: 739378 - protein, 110 aa, Homo sapiens
MRFETFRSCLPFCPPNRPLPSLLTRASRAEGWARSTRLLSHLLELQASFRCREALWANSFGIPGGRCAVRGEEEDLTAVLHPRRPTSTPVRALFQAPAGPTCQELGLRSA

SEQ ID NO: 739379 - protein, 110 aa, Homo sapiens; identical to SEQ ID NO: 739378

SEQ ID NO: 739380 - protein, 479 aa, Homo sapiens
MATALVSAHSLAPLNLKKEGLRVVREDHYSTWEQGFKLQGNSKGLGQEPLCKQFRQLRYEETTGPREALSRLRELCQQWLQPETHTKEQILELLVLEQFLIILPKELQARVQEHHPESREDVVVVLEDLQLDLGETGQQVDPDQPKKQKILVEEMAPLKGVQEQQVRHECEVTKPEKEKGEETRIENGKLIVVTDSCGRVESSGKISEPMEAHNEGSNLERHQAKPKEKIEYKCSEREQRFIQHLDLIEHASTHTGKKLCESDVCQSSSLTGHKKVLSREKGHQCHECGKAFQRSSHLVRHQKIHLGEKPYQCNECGKVFSQNAGLLEHLRIHTGEKPYLCIHCGKNFRRSSHLNRHQRIHSQEEPCECKECGKTFSQALLLTHHQRIHSHSKSHQCNECGKAFSLTSDLIRHHRIHTGEKPFKCNICQKAFRLNSHLAQHVRIHNEEKPYQCSECGEAFRQRSGLFQHQRYHHKDKLA

SEQ ID NO: 739381 - protein, 344 aa, Homo sapiens
MATALDPDQPKKQKILVEEMAPLKGVQEQQVRHECEVTKPEKEKGEETRIENGKLIVVTDSCGRVESSGKISEPMEAHNEGSNLERHQAKPKEKIEYKCSEREQRFIQHLDLIEHASTHTGKKLCESDVCQSSSLTGHKKVLSREKGHQCHECGKAFQRSSHLVRHQKIHLGEKPYQCNECGKVFSQNAGLLEHLRIHTGEKPYLCIHCGKNFRRSSHLNRHQRIHSQEEPCECKECGKTFSQALLLTHHQRIHSHSKSHQCNECGKAFSLTSDLIRHHRIHTGEKPFKCNICQKAFRLNSHLAQHVRIHNEEKPYQCSECGEAFRQRSGLFQHQRYHHKDKLA

SEQ ID NO: 739382 - protein, 479 aa, Homo sapiens; identical to SEQ ID NO: 739380

SEQ ID NO: 739383 - protein, 344 aa, Homo sapiens; identical to SEQ ID NO: 739381

SEQ ID NO: 739384 - protein, 325 aa, Homo sapiens [sequence omitted]

SEQ ID NO: 739385 - protein, 270 aa, Homo sapiens
MEAHNEGSNLERHQAKPKEKIEYKCSEREQRFIQHLDLIEHASTHTGKKLCESDVCQSSSLTGHKKVLSREKGHQCHECGKAFQRSSHLVRHQKIHLGEKPYQCNECGKVFSQNAGLLEHLRIHTGEKPYLCIHCGKNFRRSSHLNRHQRIHSQEEPCECKECGKTFSQALLLTHHQRIHSHSKSHQCNECGKAFSLTSDLIRHHRIHTGEKPFKCNICQKAFRLNSHLAQHVRIHNEEKPYQCSECGEAFRQRSGLFQHQRYHHKDKLA

SEQ ID NO: 739386 - protein, 1709 aa, Homo sapiens
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWRRRRVCKQSMGENSVEMAFQKETTQLIDPDAATCETSTCAPPLG

SEQ ID NO: 739387 - protein, 130 aa, Homo sapiens
ASGSGLTPGALRRAALSVHFSGQGRIWEPSWGTFSGAGRRALWHPEACITLPSVPPAVLPPGQASWGVSSPQDVQGVKGSCLLIPCIFSFPADVEVPDGITAIWYYDYSGQRQVVSHSADPKLVEARFRG

SEQ ID NO: 739388 - protein, 1649 aa, Homo sapiens
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRGEGRGLHLPGHSAQKPSS

SEQ ID NO: 739389 - protein, 942 aa, Homo sapiens
MASVASCDSRPSSDELPGDPSSQEEDEDYDFEDRVSDSGSYSSASSDYDDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGGSAMKSGQVLIGDVLVAVNDVDVTTENIERVLSCIPGPMQVKLTFENAYDVKRETSHPRQKKTQSNTSDLVKLLWGEEVEGIQQSGLNTPHIIMYLTLQLDSETSKEEQEILYHYPMSEASQKLKSVRGIFLTLCDMLENVTGTQVTSSSLLLNGKQIHVAYWKESDKLLLIGLPAEEVPLPRLRNMIENVIQTLKFMYGSLDSAFCQIENVPRLDHFFNLFFQRALQPAKLHSSASPSAQQYDASSAVLLDNLPGVRWLTLPLEIKMELDMALSDLEAADFAELSEDYYDMRRLYTILGSSLFYKGYLICSHLPKDDLIDIAVYCRHYCLLPLAAKQRIGQLIIWREVFPQHHLRPLADSSTEVFPEPEGRYFLLVVGLKHYMLCVLLEAGGCASKAIGSPGPDCVYVDQVKTTLHQLDGVDSRIDERLASSPVPCLSCADWFLTGSREKTDSLTTSPILSRLQGTSKVATSPTCRRTLFGDYSLKTRKPSPSCSSGGSDNGCEGGEDDGFSPHTTPDAVRKQRESQGSDGLEESGTLLKVTKKKSTLPNPFHLGNLKKDLPEKELEIYNTVKLTSGPENTLFHYVALETVQGIFITPTLEEVAQLSGSIHPQLIKNFHQCCLSIRAVFQQTLVEEKKKGLNSGDHSDSAKSVSSLNPVKEHGVLFECSPGNWTDQKKAPPVMAYWVVGRLFLHPKPQELYVCFHDSVTEIAIEIAFKLFFGLTL

SEQ ID NO: 739390 - protein, 921 aa, Homo sapiens
MASVASCDSRPSSDELPGDPSSQEEDEDYDFEDRVSDSGSYSSASSDYDDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGGSAMKSGQVLIGDVLVAVNDVDVTTENIERVLSCIPGPMQVKLTFENAYDVKRETSHPRQKKTQSNTSDLVKLLWGEEVEGIQQSGLNTPHIIMYLTLQLDSETSKEEQEILYHYPMSEASQKLKSVRGIFLTLCDMLENVTGTQVTSSSLLLNGKQIHVAYWKESDKLLLIGLPAEEVPLPRLRNMIENVIQTLKFMYGSLDSAFCQIENVPRLDHFFNLFFQRALQPAKLHSSASPSAQQYDASSAVLLDNLPGVRWLTLPLEIKMELDMALSDLEAADFAELGYLICSHLPKDDLIDIAVYCRHYCLLPLAAKQRIGQLIIWREVFPQHHLRPLADSSTEVFPEPEGRYFLLVVGLKHYMLCVLLEAGGCASKAIGSPGPDCVYVDQVKTTLHQLDGVDSRIDERLASSPVPCLSCADWFLTGSREKTDSLTTSPILSRLQGTSKVATSPTCRRTLFGDYSLKTRKPSPSCSSGGSDNGCEGGEDDGFSPHTTPDAVRKQRESQGSDGLEESGTLLKVTKKKSTLPNPFHLGNLKKDLPEKELEIYNTVKLTSGPENTLFHYVALETVQGIFITPTLEEVAQLSGSIHPQLIKNFHQCCLSIRAVFQQTLVEEKKKGLNSGDHSDSAKSVSSLNPVKEHGVLFECSPGNWTDQKKAPPVMAYWVVGRLFLHPKPQELYVCFHDSVTEIAIEIAFKLFFGLTL

SEQ ID NO: 739391 - protein, 170 aa, Homo sapiens
MECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTSKPEGKDSPASHRLGPTPEVHSLLPSRLWAFPFLLSAS

SEQ ID NO: 739392 - protein, 337 aa, Homo sapiens
LYRPSGSGGDFRAAGASVVTLGGCLISIRTHEASGPSGTASVAAMAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLQLYLTLGAAAFQPLIIYWLTFHLVR

SEQ ID NO: 739393 - protein, 293 aa, Homo sapiens
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLQLYLTLGAAAFQPLIIYWLTFHLVR

SEQ ID NO: 739394 - protein, 278 aa, Homo sapiens
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLRFGKGSSKSP

SEQ ID NO: 739395 - protein, 301 aa, Homo sapiens
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRFSPEVLGLCASTALVWVVMEVLALLLGLYLATVRSDLSTFHLLAYSGYKYVGMILSVLTGLLFGSDGYYVALAWTSSALMYFIVSLVHPPIPLPSLEGKPPPPGQASVLLSSRCALCGQQPWAPTAWGAPSPGSVSSST

SEQ ID NO: 739396 - protein, 305 aa, Homo sapiens
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRMPGSEPPLLWRRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLQLYLTLGAAAFQPLIIYWLTFHLVR

SEQ ID NO: 739397 - protein, 241 aa, Homo sapiens
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRMILSVLTGLLFGSDGYYVALAWTSSALMYFIVRSLRTAALGPDSMGGPVPRQRLQLYLTLGAAAFQPLIIYWLTFHLVR

SEQ ID NO: 739398 - protein, 284 aa, Homo sapiens
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRFSPEVLGLCASTAAGLQWLQIRGNDPQCAHGAAVRQRWLLRGAGLDLIGAHVLHCALFADSSPGPRQHGGPRPPAASPALPDSGSCSLPAPHHILADFPPGPVTPWPQMALSFSFIEDLISL

SEQ ID NO: 739399 - protein, 160 aa, Homo sapiens
PSSPSVAPVSLPHPCLRMPGSEPPLLWRRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLQLYLTLGAAAFQPLIIYWLTFHLVR

SEQ ID NO: 739400 - protein, 147 aa, Homo sapiens
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPKPFPL

SEQ ID NO: 739401 - protein, 259 aa, Homo sapiens
DGRKLRLGRGLVLEPRTWWPRPAGWGTCRAAGWPRSVPWARSSCLISIRTHEAAQRALGDSERRGHGLSLGLRSLHRFVSVSKLKYFFAVDTAYVAKKLGLLVFPYTHQNWEVQYSRDAPLPPRQDLNAPDLYIPKLPTHTADSSLSCWLHRARPIVDTQAMAFITYVLLAGMALGIQKRMILSVLTGLLFGSDGYYVALAWTSSALMYFIVRSLRTAALGPDSMGGPVPRQRLQLYLTLGAAAFQPLIIYWLTFHLVR

SEQ ID NO: 739402 - protein, 83 aa, Homo sapiens
RWFGLMLGISVIYSDTSKTHGSKHRARAAPDPPPLFDDTSGGYSSQPGGYPATGADVAFSVNHLLGDPMANVAMAYGSSIASH

SEQ ID NO: 739403 - protein, 133 aa, Homo sapiens
ISLALGSDGLHYLRAPGWDGTGHSEKVSAKPLPYPPLPVSSSPNLPRAYVVVPSSPSVAPVSLPHPCLRMPGSEPPLLWRRFSPEVLGLCASTALVWVVMEVLALLLGLYLATVRSDLSTFHLLAYSGYKYVG

SEQ ID NO: 739404 - protein, 127 aa, Homo sapiens
MSLLRNRLQALPALCLCVLVLACIGACQPEAQEGTLSPPPKLKMSRWSLVRGRMKELLETVVNRTRDGWQWFWSPSTFRGFMQTYYDDHLRDLGPLTKAWFLESKDSLLKKTHSLCPRLVCGDKDQG

SEQ ID NO: 739405 - protein, 127 aa, Homo sapiens; identical to SEQ ID NO: 739404

SEQ ID NO: 739406 - protein, 127 aa, Homo sapiens; identical to SEQ ID NO: 739404

SEQ ID NO: 739407 - protein, 149 aa, Homo sapiens
ERVPVQNHHLLVEESSVSGCAPTLRLVSPLYNGNDEDAHLIGFLWQITCQPEAQEGTLSPPPKLKMSRWSLVRGRMKELLETVVNRTRDGWQWFWSPSTFRGFMQTYYDDHLRDLGPLTKAWFLESKDSLLKKTHSLCPRLVCGDKDQG

SEQ ID NO: 739408 - protein, 457 aa, Homo sapiens
MRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRIIFRKISDVKKEEEERLRQKNEVTLSIPVDHPVRKLFQKFKQQKELRNQGSTQGDPERNQLQVESRSLQNGASITGTSVVTVSQITPIQTSLAYVKTSESLKQNNRDAMELKPNGGADQKCLKVNSPIRMKNGNGKGWLRLKNNMGAHEEKKEDWNNVTKAESMGLLSEDPKSSDSENSVTKNPLRKTDSCDSGITKSDLRLDKAGEARSPLEHSPIQADAKHPFYPIPEQALQTTLQEVKHELKEDIQLLSCRMTALEKQVAEILKILSEKSVPQASSPKSQMPLQVPPQIPCQDIFSVSRPESPESDKDEIHF

SEQ ID NO: 739409 - protein, 67 aa, Homo sapiens
APGPTPDLIKIGIFARGQEVKTSLGNMADLGLEQCTVKMAAGSRGFHRGQERHPCIPGSAEDAIHLE

SEQ ID NO: 739410 - protein, 545 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLLTSVYCAVGITYAWFKLYVSVLIDSAIGKTKKQ

SEQ ID NO: 739411 - protein, 545 aa, Homo sapiens; identical to SEQ ID NO: 739410

SEQ ID NO: 739412 - protein, 559 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKSLALLPRLECSGAISAHCILCLSLLSSWDYKHPPPCPANFCIFSRDRVSPCWPGCS

SEQ ID NO: 739413 - protein, 486 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRRSFTLVAQAGVQWHDLS

SEQ ID NO: 739414 - protein, 326 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIALYFLSLV

SEQ ID NO: 739415 - protein, 431 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASKSESSRVT

SEQ ID NO: 739416 - protein, 371 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILKRKTSF

SEQ ID NO: 739417 - protein, 104 aa, Homo sapiens
GIEGSRMWIKLVGSVRCRSNGGAHNCHGYWQLVFGFGARGDSSQMPSHPHIVRDSHGQVLGGEAPRSVRAGEKGVDIPGYEEKTLGRVCRYPAFAKLSVSPVVT

SEQ ID NO: 739418 - protein, 97 aa, Homo sapiens
GIEGSRMWIKLVGSVRCRSNGGAHNCHGYWQLVFGFGARAIPQILKYTETGLLSLTVCQYHSGIMRQLQSGRWITPLSLHGLSISCHMLPNILIKKC

SEQ ID NO: 739419 - protein, 326 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGMVAKFNY

SEQ ID NO: 739420 - protein, 152 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRDCFCFFPNVSM

SEQ ID NO: 739421 - protein, 298 aa, Homo sapiens
ASRDPGCGSSWWEACGAAAMAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLLLFSPAQRIKAAVHQPL

SEQ ID NO: 739422 - protein, 104 aa, Homo sapiens; identical to SEQ ID NO: 739417

SEQ ID NO: 739423 - protein, 526 aa, Homo sapiens
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLLTSVYCAVGVTYAWFKLYVSVLIDSAIGKTKKQ

SEQ ID NO: 739424 - protein, 546 aa, Homo sapiens
IPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 739425 - protein, 704 aa, Homo sapiens
MGRLKWTSFSTVAAPTEEHSYTLRWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 739426 - protein, 704 aa, Homo sapiens; identical to SEQ ID NO: 739425

SEQ ID NO: 739427 - protein, 208 aa, Homo sapiens
SGTEWVSVFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 739428 - protein, 289 aa, Homo sapiens [sequence omitted]

SEQ ID NO: 739429 - protein, 720 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 739430 - protein, 704 aa, Homo sapiens; identical to SEQ ID NO: 739425

SEQ ID NO: 739431 - protein, 479 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVSVSGLL

SEQ ID NO: 739432 - protein, 555 aa, Homo sapiens
MNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 739433 - protein, 604 aa, Homo sapiens
MNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVFAFSLVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 739434 - protein, 446 aa, Homo sapiens
MKASRAVLSDEAPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGVEPQRTWHLFNRTVRAISTSRAPRSSPRCPLPPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 739435 - protein, 270 aa, Homo sapiens
MNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVFAFSLVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACDNGKHEKRMN

SEQ ID NO: 739436 - protein, 113 aa, Homo sapiens
MTSYVSLVKQLNGGGEERRVPGRGSRGLSGKRRMMNKLYIGNLSPAVTADDLRQLFGDRKLPLAGQVLLKSGYAFVDYPDQNWAIRAIETLSGKVELHGKIMEVDYSVSKKLR

SEQ ID NO: 739437 - protein, 598 aa, Homo sapiens
MNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 739438 - protein, 359 aa, Homo sapiens
MNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNVSP

SEQ ID NO: 739439 - protein, 115 aa, Homo sapiens
MNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQGNK

SEQ ID NO: 739440 - protein, 71 aa, Homo sapiens
NLFIPTQAVGAIIGKKGAHIKQLARFAGASIKVRLLLTALWPFYHLLSSHGPCSLSVPGSATPCRDRVPQR

SEQ ID NO: 739441 - protein, 127 aa, Homo sapiens
PQLRFRHLRTLLKGLTLKPHAGVEIPQHCLARLPSSLFPHVGKEKQPFQNYGGCFLQMSGPGVHSVSSNRNKLTGQARWLMPVIPALWEAKAGGSPEVGSSRPAWPTWRNPISTKNTKLARCGVGRL

SEQ ID NO: 739442 - protein, 68 aa, Homo sapiens
RYLNYSSSSSLLTNNPSEAERKIYLAIESANELAVQKAKAEITRLIKEELIRLQNSYQPTNKGRYKVL

SEQ ID NO: 739443 - protein, 496 aa, Homo sapiens
MFSFSQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 739444 - protein, 346 aa, Homo sapiens
RGPWQVEIRTTGTGEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 739445 - protein, 359 aa, Homo sapiens
MFSFSQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVLSNLFQVSVNTFKKFFDFTFQELC

SEQ ID NO: 739446 - protein, 496 aa, Homo sapiens; identical to SEQ ID NO: 739443

SEQ ID NO: 739447 - protein, 68 aa, Homo sapiens; identical to SEQ ID NO: 739442

SEQ ID NO: 739448 - protein, 302 aa, Homo sapiens
MFSFSQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEPIESMFNSKPELRRPEQPETEQP

SEQ ID NO: 739449 - protein, 74 aa, Homo sapiens
EQEADKEVDEEGEESGEEEEEEKEGDGEEEDGDEEEAESATGKRAAEDDEDDDVDTKKQKTDKDDKTAKKEKLN

SEQ ID NO: 739450 - protein, 613 aa, Homo sapiens
HPLFSSGTAQTCAPKMRAQEDLEGRAQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFASLPDPILGGMFCTLFGMITAVGLSNLQFVDMNSSRNLFVLGFSMFFGLTLPNYLSPNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 739451 - protein, 613 aa, Homo sapiens; identical to SEQ ID NO: 739450

SEQ ID NO: 739452 - protein, 800 aa, Homo sapiens
ARYPSPLCARVLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEEAVKDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 739453 - protein, 631 aa, Homo sapiens
PTSSKKTMNPHDIVQDANPNSHPAYQQYTSKSTLEPGPTWRGGCPGLSGSQAFSGARDNEKTLLLSSDDEFWCGLQWRKCWRHSHGQAVPHLQPHHQARRQLAQCSRRLYLLDQKHSHVASRGTGDSQARPWAFRKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 739454 - protein, 800 aa, Homo sapiens; identical to SEQ ID NO: 739452

SEQ ID NO: 739455 - protein, 138 aa, Homo sapiens
HAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGQGEGRKKDSALLSKRRKCGKYGITSLRTY

SEQ ID NO: 739456 - protein, 853 aa, Homo sapiens
ARYPSPLCARVLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEEAVKDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLTDGHPLPGQAASRSHQGPVGPGFSANMEDHFLIGHFPFFFLFSFPCFCTKPLCREYFLICSIQDESK

SEQ ID NO: 739457 - protein, 1162 aa, Homo sapiens
RAGEVVPGWLLAAAAAHPGRPAASLSPGLGAVLGVAGRQVADPRFRRDWFRIPSPPAESAGPARQAGFAAAPPARAGPALSTMKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQAAVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNAGGGLPAAGPGDRCLPTSDSSPEPQQPPEDRTQDVLAQDAAGDNLEMMAPSRGSAKSRGPLEELLHTLQLLEKEPDALPRPRTHHRGRYAWASEEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 739458 - protein, 1309 aa, Homo sapiens
RAGEVVPGWLLAAAAAHPGRPAASLSPGLGAVLGVAGRQVADPRFRRDWFRIPSPPAESAGPARQAGFAAAPPARAGPALSTMKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQAAVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNAGGLPAAGPGDRCLPTSDSSPEPQQPPEDRTQDVLAQDAAGDNLEMMAPSRGSAKSRGPLEELLHTLQLLEKEPDALPRPRTHHRGRYAWASEVTTEDDASSLTADNLEKFGKLSAFPEPPEDGTLLSEAKLQSIMSFLDEMEKSGQELSPTPGGTAHQALKANNAGGGLPAAGPGDRCLPTSDSSPEPQQPPEDRTQDVLAQDAAGDNLEMMAPSRGSAKSRGPLEELLHTLQLLEKEPDALPRPRTHHRGRYAWASEEDDASSLTADNLEKFGKLSAFPEPPEDGTLLSEAKLQSIMSFLDEMEKSGQDHWGPEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 739459 - protein, 960 aa, Homo sapiens
HEAGWEVFQPFKMLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLLEQAQLNQWRPGDIWHGHPCTGSEASSPSLSCLLLLPQSLLPFSSSFKPSLPRFPSYLSSLLVSFLCLNPVTQPLTPLSTFLSKYTDTSCPRKLCDFKSLLSLLESVFVHKYKSVYLFKKKKKKTRTEFLSLSQRCLRQAEELREQLEREKEALGQQERERARQRQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 739460 - protein, 169 aa, Homo sapiens
MAGSRSWWGFTFPAGPEIPRTLGDSRALWGNLWSGSGFRLPDVNATWHRLLWQEQRQRSGEGTLLDLHQQKEAARRKAREEKARQARRAAIQVLTAQGPLSSTVAQALTVRGCCWGSLGPGTLSLRAAWLWSLGSSSPRDSAQRCSHCRPLPRAASTSPYVWIVQPSGA

SEQ ID NO: 739461 - protein, 1128 aa, Homo sapiens
RAGEVVPGWLLAAAAAHPGRPAASLSPGLGAVLGVAGRQVADPRFRRDWFRIPSPPAESAGPARQAGFAAAPPARAGPALSTMKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQAAVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNAGGGLPAAGPGDRCLPTSDSSPEPQQPPEDRTQDVLAQDAAGDNLEMMAPSRGSAKSRGPLEELLHTLQLLEKEPDALPRPRTHHRGRYAWASEEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEVSPCGQPCWTSGLGAGLTLWVCCRLR

SEQ ID NO: 739462 - protein, 1219 aa, Homo sapiens
RAGEVVPGWLLAAAAAHPGRPAASLSPGLGAVLGVAGRQVADPRFRRDWFRIPSPPAESAGPARQAGFAAAPPARAGPALSTMKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQAAVTIQRWYRHQVQRRGAGAARLEHLLQAKREEQRQRSGEGTLLDLHQQKEAARRKAREEKARQARRAAIQVLTAQGPLSSTVAQALTVRGCCWGSLGPGTLSLRAAWLWSLGSSSPRDSAQRCSHCRELQQKRALRAQKASTAERGPPENPRETRVPGMRQPAQELSPTPGGTAHQALKANNAGGGLPAAGPGDRCLPTSDSSPEPQQPPEDRTQDVLAQDAAGDNLEMMAPSRGSAKSRGPLEELLHTLQLLEKEPDALPRPRTHHRGRYAWASEEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 739463 - protein, 371 aa, Homo sapiens
KRSLVEAVLHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 739464 - protein, 93 aa, Homo sapiens
AALSYQQPCCICLPALLQDVLAQDAAGDNLEMMAPSRGSAKSRGPLEELLHTLQLLEKEPDALPRPRTHHRGRYAWASEVTTVCARPAQSVHP

SEQ ID NO: 739465 - protein, 52 aa, Homo sapiens
MLNLQTFTFLSMFLRGRQRNSQFMMQNGTSGQLFDLCDLDHTSYKWGSNCSV

SEQ ID NO: 739466 - protein, 138 aa, Homo sapiens
IKQSLALSLTLECNCSIRAHCSLDLLGSSDPSTSASLVAGTIEACHHDHLIFFCTEMESRYVAQTGLELLGSGDPPASASQKCWDYRHEPPCLAGYCCKPLSFEGCFLTQQNQPIQSSILDSPLLFSCMLSSGDSYGF

SEQ ID NO: 739467 - protein, 519 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 739468 - protein, 191 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHR

SEQ ID NO: 739469 - protein, 519 aa, Homo sapiens; identical to SEQ ID NO: 739467

SEQ ID NO: 739470 - protein, 519 aa, Homo sapiens; identical to SEQ ID NO: 739467

SEQ ID NO: 739471 - protein, 157 aa, Homo sapiens [sequence omitted]

SEQ ID NO: 739472 - protein, 526 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTLRDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 739473 - protein, 181 aa, Homo sapiens
PPWPSSLSAQPAPGDQPAPWRDPMGAYMESATLAAPGLWLTFPVSLPLCHQDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 739474 - protein, 537 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTLRVRTRVQSPRAVCVGDIWRRGGDKSQGSLAPAAACGCPSRALWEPGPPLSHVTTPGMIGIGHTQEDRARAGHVGCSCGRSLTGSRFRQCGCPAGVGGFQSCSHIQAPASRSTALGEAEKGASRTVESPAEGVGGRDECSRDG

SEQ ID NO: 739475 - protein, 109 aa, Homo sapiens
MWQDVFLGGSHASPHPLWCKQGLVINEMLNPPEVSAHVPETHLPPQQPVGKLDFVSAYLFLNTLFCSLTLLTTFQFAHIRISSVLRCIFSFCNPDLLEIRICLAVNKIL

SEQ ID NO: 739476 - protein, 522 aa, Homo sapiens
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPTAFLSR

SEQ ID NO: 739477 - protein, 1464 aa, Homo sapiens
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPIPSPNLYSQLNALQFTVDERSILWLNQFLLDLKQSLNQFMAVYKLNDNSKSDEHVDVRVDGLMLKFVIPSEVKSECHQDQPRAISIQSSEMIATNTRHCPNCRHSDLEALFQDFKDCDFFSKTYTSFPKSCDNFNLLHPIFQRHAHEQDTKMHEIYKGNITPQLNKNTLKTSAATDVWAVYFSQFWIDYEGMKSGKGRPISFVDSFPLSIWICQPTRYAESQKEPQTCNQVSLNTSQSESSDLAGRLKRKKLLKEYYSTESEPLTNGGQKPSSSDTFFRFSPSSSEADIHLLVHVHKHVSMQINHYQYLLLLFLHESLILLSENLRKDVEAVTGSPASQTSICIGILLRSAELALLLHPVDQANTLKSPVSESVSPVVPDYLPTENGDFLSSKRKQISRDINRIRSVTVNHMSDNRSMSVDLSHIPLKDPLLFKSASDTNLQKGISFMDYLSDKHLGKISEDESSGLVYKSGSGEIGSETSDKKDSFYTDSSSILNYREDSNILSFDSDGNQNILSSTLTSKGNETIESIFKAEDLLPEAASLSENLDISKEETPPVRTLKSQSSLSGKPKERCPPNLAPLCVSYKNMKRSSSQMSLDTISLDSMILEEQLLESDGSDSHMFLEKGNKKNSTTNYRGTAESVNAGANLQNYGETSPDAISTNSEGAQENHDDLMSVVVFKITGVNGEIDIRGEDTEICLQVNQVTPDQLGNISLRHYLCNRPVGSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQLMEENESLKQELAKAKMALAEAHLEKDALLHHIKKMTVE

SEQ ID NO: 739478 - protein, 1416 aa, Homo sapiens
MLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPIPSPNLYSQLNALQFTVDERSILWLNQFLLDLKQSLNQFMAVYKLNDNSKSDEHVDVRVDGLMLKFVIPSEVKSECHQDQPRAISIQSSEMIATNTRHCPNCRHSDLEALFQDFKDCDFFSKTYTSFPKSCDNFNLLHPIFQRHAHEQDTKMHEIYKGNITPQLNKNTLKTSAATDVWAVYFSQFWIDYEGMKSGKGRPISFVDSFPLSIWICQPTRYAESQKEPQTCNQVSLNTSQSESSDLAGRLKRKKLLKEYYSTESEPLTNGGQKPSSSDTFFRFSPSSSEADIHLLVHVHKHVSMQINHYQYLLLLFLHESLILLSENLRKDVEAVTGSPASQTSICIGILLRSAELALLLHPVDQANTLKSPVSESVSPVVPDYLPTENGDFLSSKRKQISRDINRIRSVTVNHMSDNRSMSVDLSHIPLKDPLLFKSASDTNLQKGISFMDYLSDKHLGKISEDESSGLVYKSGSGEIGSETSDKKDSFYTDSSSILNYREDSNILSFDSDGNQNILSSTLTSKGNETIESIFKAEDLLPEAASLSENLDISKEETPPVRTLKSQSSLSGKPKERCPPNLAPLCVSYKNMKRSSSQMSLDTISLDSMILEEQLLESDGSDSHMFLEKGNKKNSTTNYRGTAESVNAGANLQNYGETSPDAISTNSEGAQENHDDLMSVVVFKITGVNGEIDIRGEDTEICLQVNQVTPDQLGNISLRHYLCNRPVGSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQLMEENESLKQELAKAKMALAEAHLEKDALLHHIKKMTVE

SEQ ID NO: 739479 - protein, 1376 aa, Homo sapiens [sequence omitted]

SEQ ID NO: 739480 - protein, 805 aa, Homo sapiens
GRFACNIFIKSDTYLAHHKWWNKNTLKTSAATDVWAVYFSQFWIDYEGMKSGKGRPISFVDSFPLSIWICQPTRYAESQKEPQTCNQVSLNTSQSESSDLAGRLKRKKLLKEYYSTESEPLTNGGQKPSSSDTFFRFSPSSSEADIHLLVHVHKHVSMQINHYQYLLLLFLHESLILLSENLRKDVEAVTGSPASQTSICIGILLRSAELALLLHPVDQANTLKSPVSESVSPVVPDYLPTENGDFLSSKRKQISRDINRIRSVTVNHMSDNRSMSVDLSHIPLKDPLLFKSASDTNLQKGISFMDYLSDKHLGKISEDESSGLVYKSGSGEIGSETSDKKDSFYTDSSSILNYREDSNILSFDSDGNQNILSSTLTSKGNETIESIFKAEDLLPEAASLSENLDISKEETPPVRTLKSQSSLSGKPKERCPPNLAPLCVSYKNMKRSSSQMSLDTISLDSMILEEQLLESDGSDSHMFLEKGNKKNSTTNYRGTAESVNAGANLQNYGETSPDAISTNSEGAQENHDDLMSVVVFKITGVNGEIDIRGEDTEICLQVNQVTPDQLGNISLRHYLCNRPVGSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQLMEENESLKQELAKAKMALAEAHLEKDALLHHIKKMTVE

SEQ ID NO: 739481 - protein, 1464 aa, Homo sapiens; identical to SEQ ID NO: 739477

SEQ ID NO: 739482 - protein, 1464 aa, Homo sapiens; identical to SEQ ID NO: 739477

SEQ ID NO: 739483 - protein, 1464 aa, Homo sapiens; identical to SEQ ID NO: 739477

SEQ ID NO: 739484 - protein, 1464 aa, Homo sapiens; identical to SEQ ID NO: 739477

SEQ ID NO: 739485 - protein, 339 aa, Homo sapiens [sequence omitted]

SEQ ID NO: 739486 - protein, 1440 aa, Homo sapiens
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPIPSPNLYSQLNALQFTVDERSILWLNQFLLDLKQSLNQFMAVYKLNDNSKSDEHVDVRVDGLMLKFVIPSEVKSECHQDQPRAISIQSSEMIATNTRHCPNCRHSDLEALFQDFKDCDFFSKTYTSFPKSCDNFNLLHPIFQRHAHEQDTKMHEIYKGNITPQLNKNTLKTSAATDVWAVYFSQFWIDYEGMKSGKGRPISFVDSFPLSIWICQPTRYAESQKEPQTCNQVSLNTSQSESSDLAGRLKRKKLLKEYYSTESEPLTNGGQKPSSSDTFFRFSPSSSEADIHLLVHVHKHVSMQINHYQYLLLLFLHESLILLSENLRKDVEAVTGSPASQTSICIGILLRSAELALLLHPVDQANTLKSPVSESVSPVVPDYLPTENGDFLSSKRKQISRDINRIRSVTVNHMSDNRSMSVDLSHIPLKDPLLFKSASDTNLQKGISFMDYLSDKHLGKISEDESSGLVYKSGSGEIGSETSDKKDSFYTDSSSILNYREDSNILSFDSDGNQNILSSTLTSKGNETIESIFKAEDLLPEAASLSENLDISKEETPPVRTLKSQSSLSGKPKERCPPNLAPLCVSYKNMKRSSSQMSLDTISLDSMILEEQLLESDGSDSHMFLEKGNKKNSTTNYRGTAESVNAGANLQNYGETSPDAISTNSEGAQENHDDLMSVVVFKITGVNGEIDIRGEDTEICLQVNQVTPDQLGNISLRHYLCNRPVGSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQVMGNLIQIQLQQLNN

SEQ ID NO: 739487 - protein, 452 aa, Homo sapiens
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTDTYVVGRTDIKRGITDTVYILEV

SEQ ID NO: 739488 - protein, 67 aa, Homo sapiens
MHQAQFPMTSGNLCATAKLRHHSSRWLRRSGAFSSGSTLKPPPSPSPAPLCHADNLRTGRTRPSGGR

SEQ ID NO: 739489 - protein, 96 aa, Homo sapiens
MEPPHGSSVKVCTSLRKLKQTKQGWSPQFTAGCTGDAPSTVSYDKWKPVRHSSRWLRRSGAFSSGSTLKPPPSPSPAPLCHADNLRTGRTRPSGGR

SEQ ID NO: 739490 - protein, 839 aa, Homo sapiens
MWLVIVYGFKNSPTIFEEALASDLKAFVPPNDKCVLLQYIGDLLFAAPTEEDCFQGTKDLLCLLWKAGYKMSKEKAQVCAKRVRYLGFLVAQGQRELGSGQKEAICALPTPVTRRQVREFLGAAGFCCTSMPNFHSRQSHCMKPQSGGEKEPLLWGNEQKKAFNEIKKALSQARALGLPDLTKPFFFYVHEKKRNDYRSFSSNSRIMVLTSSLFIKAVRPCGPGVAPLLKSISCHCHAGRKCWKLTPGQKLIIRVPHTVITLMEQRGYITGYANPRMLRYQGLLCGNPYVTLKTANTLNPATLLPVEMSKLQDQFPQRYCVDVVDEVFSSRKDLRDQPFKDPDAEYFTEGSRFVSEGAAEPGMQGDSKFSSQGTGPPYQDLSTKSRIALNRALLVAKGRTVNIYTDSKYAFATLHAHGAIYKERGLLTAGGKEIKEEILQLLEAVWAPDKVAVIHCKGHQTRGGIEAKGNRKADREARQAAMSNSSTKKKTPTLLLLLEPSLPETPSYSPNEKAWFEQESGSYIQGGRWKFSDGRLAIPEAIAPQFMKQFHQGTHMGKTALETLVGWHFYVPCLTAITRAVCEQCLTCAQNNPWQVPTQPPGIQETGATPCENLLVDFTELPRARGYQYMLVFVCTFSGWVEAFPTRIEKAQEVTRLLLKDIIPRFGLPLTLGSDNGPAFMAEVVQQLSQLLKIKWKLHIVYHPQSSGKVQWMNQTLKHLLKFCQEPHLRWDQVLPMAFLQVRCTLTKLTGLSPCEIVFGRPPPIINQVKGDLWELGELTLKRQMQALGLAMQKIHGWVREKLPISLTDPVHPFTPGDLVWVKKWNPTTLGPIWDGPTL

SEQ ID NO: 739491 - protein, 821 aa, Homo sapiens
MWLVIVYGFKNSPTIFEEALASDLKAFVPPNDKCVLLQYIGDLLFAAPTEEDCFQGTKDLLCLLWKAGYKMSKEKAQVCAKRVRYLGFLVAQGQRELGSGQKEAICALPTPVTRRQVREFLGAAGFCCTSMPNFHSRQSHCMKPQSGGEKEPLLWGNEQKKAFNEIKKALSQARALGLPDLTKPFFFYVHEKKRNDYRSFSSNSRIMVLTSSLFIKAVRPCGPGVAPLLKSISCHCHAGRKCWKLTPGQKLIIRVPHTVITLMEQRGYITGYANPRMLRYQGLLCGNPYVTLKTANTLNPATLLPVEMSKLQDQFPQRYCVDVVDEVFSSRKDLRDQPFKDPDAEYFTEGSRFVSEGAAEPGMQGDSKFSSQGTGPPYQDLSTKSRIALNRALLVAKGRTVNIYTDSKYAFATLHAHGAIYKERGLLTAGGKEIKEEILQLLEAVWAPDKVAVIHCKGHQTRGGIEAKGNRKADREARQAAMSNSSTKKKTPTLLLLLEPSLPETPSYSPNEKAWFEQESGSYIQGGRWKFSDGRLAIPEAIAPQFMKQFHQGTHMGKTALETLVGWHFYVPCLTAITRAVCEQCLTCAQNNPWQVPTQPPGIQETGATPCENLLVDFTELPRARGYQYMLVFVCTFSGWVEAFPTRIEKAQEVTRLLLKDIIPRFGLPLTLGSDNGPAFMAEVVQQLSQLLKIKWKLHIVYHPQSSGKVQWMNQTLKHLLKFCQEPHLRWDQVLPMAFLQVRCTLTKLTGLSPCEIVFGRPPPIINQVKGDLWELGELTLKRQMQALGLAMQKIHGWVREVWVKKWNPTTLGPIWDGPTL

SEQ ID NO: 739492 - protein, 61 aa, Homo sapiens
VLCLTRAQQPRAHTWQMHRLEGRTGVWAVPRWCLEGSSSDRRETRPRGAACQSMFWELLIV

SEQ ID NO: 739493 - protein, 454 aa, Homo sapiens
MARPNKFLLWFCCFAWLCFPISLGSQASGGEAQIAASAELESGAMPWSLLQHIDERDRAGLLPALFKVLSVGRGGSPRLQPDSRALHYMKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 739494 - protein, 138 aa, Homo sapiens
SCYLSALSLSSAMPDPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 739495 - protein, 55 aa, Homo sapiens
MESPKCLYSRITVNTAFGTKFSHISFIILFKVFLFPRITISKKTKLVTLSNYLNK

SEQ ID NO: 739496 - protein, 129 aa, Homo sapiens
RASTAFFQEEGPCGACPGALRPQAGASFRELRGLPPPRPREREQSPPLGAAPSSALSHQGWKNTRCATRGLVNTLVNTGHFLYLQPPAPLIMPYLDDAEVPGNRRSHPSLSFSWLSKALYHVTFLLRIL

SEQ ID NO: 739497 - protein, 113 aa, Homo sapiens
RASTAFFQEEGPCGACPGALRPQAGASFRELRGLPPPRPREREQSPPLGAAPSSALSHQGWKNTRCATRGLVNTLVNTGHFLYLQPPAFLLPVTSINRAYMEPAGKDKFHCHN

SEQ ID NO: 739498 - protein, 129 aa, Homo sapiens; identical to SEQ ID NO: 739496

SEQ ID NO: 739499 - protein, 635 aa, Homo sapiens
GRARRGSRGGAGSAGRPGCAGRAAARRGPSAGAAAGRRRELAASAAAPGQPARSGSAMELPAVGEHVFAVESIEKKRIRKGRVEYLVKWRGWSPKYNTWEPEENILDPRLLIAFQNRERQEQLMGYRKRGPKPKPLVVQVPTFARRSNVLTGLQDSSTDNRAKLDLGAQGKGQGHQYELNSKKHHQYQPHSKERAGKPPPPGKSGKYYYQLNSKKHHPYQPDPKMYDLQYQGGHKEAPSPTCPDLGAKSHPPDKWAQGAGAKGYLGAVKPLAGAAGAPGKGSEKGPPNGMMPAPKEAVTGNGIGGKMKIVKNKNKNGRIVIVMSKYMENGMQAVKIKSGEVAEGEARSPSHKKRAADERHPPADRTFKKAAGAEEKKVEAPPKRREEEVSGVSDPQPQDAGSRKLSPTKEAFGEQPLQLTTKPDLLAWDPARNTHPPSHHPHPHPHHHHHHHHHHHHAVGLNLSHVRKRCLSETHGEREPCKKRLTARSISTPTCLGGSPAAERPADLPPAAALPQPEVILLDSDLDEPIDLRSVKSAQRGRGAAQLPPGEARDTGVGGGGGGGGSGTHHDGGEASSRGPGRTCRVAERVQALLWEYNYHRRHRELPHRYFQGVRDGVAGGRRKGKRHSRGGAGS

SEQ ID NO: 739500 - protein, 635 aa, Homo sapiens; identical to SEQ ID NO: 739499

SEQ ID NO: 739501 - protein, 347 aa, Homo sapiens
GRARRGSRGGAGSAGRPGCAGRAAARRGPSAGAAAGRRRELAASAAAPGQPARSGSAMELPAVGEHVFAVESIEKKRIRKGRVEYLVKWRGWSPKYNTWEPEENILDPRLLIAFQNRERQEQLMGYRKRGPKPKPLVVQVPTFARRSNVLTGLQDSSTDNRAKLDLGAQGKGQGHQYELNSKKHHHTPSAMNLSHVRKRCLSETHGEREPCKKRLTARSISTPTCLGGSPAAERPADLPPAAALPQPEVILLDSDLDEPIDLRSVKTRSEAGEPPSSLQVKPETPASAAVAVAAAAAPTTTAEKPPAEAQDEPAESLSEFKPFFGNIIITDVTANCLTVTFKEYVTV

SEQ ID NO: 739502 - protein, 512 aa, Homo sapiens
MGYRKRGPKPKPLVVQVPTFARRSNVLTGLQDSSTDNRAKLDLGAQGKGQGHQYELNSKKHHQYQPHSKERAGKPPPPGKSGKYYYQLNSKKHHPYQPDPKMYDLQYQGGHKEAPSPTCPDLGAKSHPPDKWAQGAGAKGYLGAVKPLAGAAGAPGKGSEKGPPNGMMPAPKEAVTGNGIGGKMKIVKNKNKNGRIVIVMSKYMENGMQAVKIKSGEVAEGEARSPSHKKRAADERHPPADRTFKKAAGAEEKKVEAPPKRREEEVSGVSDPQPQDAGSRKLSPTKEAFGEQPLQLTTKPDLLAWDPARNTHPPSHHPHPHPHHHHHHHHHHHHAVGLNLSHVRKRCLSETHGEREPCKKRLTARSISTPTCLGGSPAAERPADLPPAAALPQPEVILLDSDLDEPIDLRSVKSAQRGRGAAQLPPGEARDTGVGGGGGGGGSGTHHDGGEASSRGPGRTCRVAERVQALLWEYNYHRRHRELPHRYFQGVRDGVAGGRRKGKRHSRGGAGS

SEQ ID NO: 739503 - protein, 197 aa, Homo sapiens
MLVLPSPCPQPLAFSSVETMEGPPRRTCRSPEPGPSSSIGSPQASSPPRPNHYLLIDTQGVPYTVLVDEESQREPGASGAPGQKKCYSCPVCSRVFEYMSYLQRHSITHSEVKPFECDICGKAFKRASHLARHHSIHLAGGGRPHGCPLCPRRFRDAGELAQHSRVHSGERPFQCPHCPRRFMEQNTLQKHTRWKHP

SEQ ID NO: 739504 - protein, 197 aa, Homo sapiens; identical to SEQ ID NO: 739503

SEQ ID NO: 739505 - protein, 176 aa, Homo sapiens
MLVLPSPCPQPLAFSSSIGSPQASSPPRPNHYLLIDTQGVPYTVLVDEESQREPGASGAPGQKKCYSCPVCSRVFEYMSYLQRHSITHSEVKPFECDICGKAFKRASHLARHHSIHLAGGGRPHGCPLCPRRFRDAGELAQHSRVHSGERPFQCPHCPRRFMEQNTLQKHTRWKHP

SEQ ID NO: 739506 - protein, 197 aa, Homo sapiens; identical to SEQ ID NO: 739503

SEQ ID NO: 739507 - protein, 197 aa, Homo sapiens; identical to SEQ ID NO: 739503

SEQ ID NO: 739508 - protein, 214 aa, Homo sapiens
RAAGGAGPRGGPQPALRMLVLPSPCPQPLAFSSVETMEGPPRRTCRSPEPGPSSSIGSPQASSPPRPNHYLLIDTQGVPYTVLVDEESQREPGASGAPGQKKCYSCPVCSRVFEYMSYLQRHSITHSEVKPFECDICGKAFKRASHLARHHSIHLAGGGRPHGCPLCPRRFRDAGELAQHSRVHSGERPFQCPHCPRRFMEQNTLQKHTRWKHP

SEQ ID NO: 739509 - protein, 135 aa, Homo sapiens
LGNEAELLESMGDAPPPQDEHTTIIDRGPGACEESNHLLLNGGSHKHVQSQIHRSADSGGRQGREQKQDPLHSPTSKRKKVKFTTFTTIPPDDSCPTVNSIVSSNDEDIKWVCQDVAVGAPKELRNYLEKLKDKA

SEQ ID NO: 739510 - protein, 168 aa, Homo sapiens
EIKGKMDAVVNFTYQYLSAPLCVTVWVPRLPLQIEVSDTELSQIKGWRVPIVTNEEVSVVQMNFEIASFSSLSGTQPITWQVEYPRKGTTDIAVSEIFVSQKDLVGIVPLAMGVKFTTFTTIPPDDSCPTVNSIVSSNDEDIKWVCQDVAVGAPKELRNYLEKLKDKA

SEQ ID NO: 739511 - protein, 202 aa, Homo sapiens
MASQGRRRRPLRRPETVVPGEATETDSERSASSSEEEELYLGPSGPTRGRPTGLRVAGEAAETDSEPEPEPEPTAAPRDLPPLVVQRESAEEAWGTEEAPAPAPARSLLQLRLAESQARLDHDVAAAVSGVYRRAGRDVAALASRLAAAQAAGLAAAHSVRLARGDLCALAERLDIVAGCRLLPDIRGVPGTEPEKDPGPRA

SEQ ID NO: 739512 - protein, 202 aa, Homo sapiens; identical to SEQ ID NO: 739511

SEQ ID NO: 739513 - protein, 202 aa, Homo sapiens; identical to SEQ ID NO: 739511

SEQ ID NO: 739514 - protein, 202 aa, Homo sapiens; identical to SEQ ID NO: 739511

SEQ ID NO: 739515 - protein, 78 aa, Homo sapiens
TTKFAAASTYEWKNLDGISHAPNAVKTAFYLAEFFVNEARKNNHHFKSESEEEKALIYQFSPIYTGNISSFQQCYIFD

SEQ ID NO: 739516 - protein, 318 aa, Homo sapiens
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNLDGISHAPNAVKTAFYLAEFFVNEARKNNHHFKSESEEEKALIYQFSPIYTGNISSFQQCYIFD

SEQ ID NO: 739517 - protein, 318 aa, Homo sapiens; identical to SEQ ID NO: 739516

SEQ ID NO: 739518 - protein, 318 aa, Homo sapiens; identical to SEQ ID NO: 739516

SEQ ID NO: 739519 - protein, 318 aa, Homo sapiens; identical to SEQ ID NO: 739516

SEQ ID NO: 739520 - protein, 279 aa, Homo sapiens [sequence omitted]

SEQ ID NO: 739521 - protein, 300 aa, Homo sapiens
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNLDGISHAPNAVKTAFYLAEFFVNEARKNNHHFKSESEEEKALIYQFSPIYTGNISSFQQCYIFD

SEQ ID NO: 739522 - protein, 186 aa, Homo sapiens
SFNCSLRLSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNLDGISHAPNAVKTAFYLAEFFVNEARKNNHHFKSESEEEKALIYQFSPIYTGNISSFQQCYIFD

SEQ ID NO: 739523 - protein, 262 aa, Homo sapiens
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNFSEKQPSF

SEQ ID NO: 739524 - protein, 205 aa, Homo sapiens
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNLQ

SEQ ID NO: 739525 - protein, 256 aa, Homo sapiens
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEVFLGIFLNGVVKKKSKRIKGARMK

SEQ ID NO: 739526 - protein, 205 aa, Homo sapiens
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKVSH

SEQ ID NO: 739527 - protein, 195 aa, Homo sapiens
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVH

SEQ ID NO: 739528 - protein, 315 aa, Homo sapiens
MSKKGRSKGEKPEMETDAVQMANEELRAKLTSIQIEFQQEKSKMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKNEMQDAKDQNELLEFRVLELEVRDSICCKLSNGADILFEPKLKFM

SEQ ID NO: 739529 - protein, 461 aa, Homo sapiens
MSKKGRSKGEKPEMETDAVQMANEELRAKLTSIQIEFQQEKSKMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEVRDSICCKLSNGADILFEPKLKFM

SEQ ID NO: 739530 - protein, 126 aa, Homo sapiens [sequence omitted]

SEQ ID NO: 739531 - protein, 134 aa, Homo sapiens
MPEPAKSAPAPKKGSKKAVTKAQKKDGKKRKRSRKESYSIYVYKVLKQVHPDTGISSKAMGIMNSFVNDIFERIAGLPSEESTCREVQETELTERQEALRAGELLLEQGGVLRAAPCLRPAGGVAETSQQAHLH

SEQ ID NO: 739532 - protein, 126 aa, Homo sapiens [sequence omitted]

SEQ ID NO: 739533 - protein, 126 aa, Homo sapiens [sequence omitted]

SEQ ID NO: 739534 - protein, 126 aa, Homo sapiens [sequence omitted]

SEQ ID NO: 739535 - protein, 79 aa, Homo sapiens
MHRSSPRSPCHPAEYTVAVPKSMFPGLFMLGTFLWSLIEYLIHRFLFHMKPPSDSYYLIMLHFVMHGQHHKSRRLRPRR

SEQ ID NO: 739536 - protein, 393 aa, Homo sapiens
RRSGWQQSRRRAARWELRSPAMAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTEYTVAVPKSMFPGLFMLGTFLWSLIEYLIHRFLFHMKPPSDSYYLIMLHFVMHGQHHKAPFDGSRLVFPPVPASLVIGVFYLCMQLILPEAVGGTVFAGGLLGYVLYDMTHYYLHFGSPHKGSYLYSLKAHHVKHHFAHQKSGFGISTKLWDYCFHTLTPEKPHLKTQ

SEQ ID NO: 739537 - protein, 181 aa, Homo sapiens [sequence omitted]

SEQ ID NO: 739538 - protein, 209 aa, Homo sapiens
MGSEPPAHPTHPAHPAHPAHPMFLCNLPGPFLAHKWEVRQSLQIFQTWWPALPKATKGAKPTQWNVWAAVPLSSAGSGQGLASCRGPWLLLMPKPLHLQAPFDGSRLVFPPVPASLVIGVFYLCMQLILPEAVGGTVFAGGLLGYVLYDMTHYYLHFGSPHKGSYLYSLKAHHVKHHFAHQKSGFGISTKLWDYCFHTLTPEKPHLKTQ

SEQ ID NO: 739539 - protein, 372 aa, Homo sapiens
MAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTEYTVAVPKSMFPGLFMLGTFLWSLIEYLIHRFLFHMKPPSDSYYLIMLHFVMHGQHHKAPFDGSRLVFPPVPASLVIGVFYLCMQLILPEAVGGTVFAGGLLGYVLYDMTHYYLHFGSPHKGSYLYSLKAHHVKHHFAHQKSGFGISTKLWDYCFHTLTPEKPHLKTQ

SEQ ID NO: 739540 - protein, 372 aa, Homo sapiens; identical to SEQ ID NO: 739539

SEQ ID NO: 739541 - protein, 181 aa, Homo sapiens [sequence omitted]

SEQ ID NO: 739542 - protein, 231 aa, Homo sapiens
MARSRRRAARWELRSPAMAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTGNASFFPDLP

SEQ ID NO: 739543 - protein, 317 aa, Homo sapiens
MWLYLAVFVGLYYLLHWYRERQVLSHLRDKYVFITGCDSGFGKLLARQLDARGLRVLAACLTEKGAEQLRGQTSDRLETVTLDVTKTESVAAAAQWVKECVRDKGLWGLVNNAGISLPTAPNELLTKQDFVTILDVNLLGVIDVTLSLLPLVRKARGRVVNVSSVMGRVSLFGGGYCISKYGVEAFSDSLRRELSYFGVKVAMIEPGYFKTAVTSKERFLKSFLEIWDRSSPEVKEAYGEKFVADYKKSAEQMEQKCTQDLSLVTNCMEHALIACHPRTRYSAGWDAKLLYLPMSYMPTFLVDAIMYWVSPSPAKAL

SEQ ID NO: 739544 - protein, 317 aa, Homo sapiens; identical to SEQ ID NO: 739543

SEQ ID NO: 739545 - protein, 317 aa, Homo sapiens; identical to SEQ ID NO: 739543

SEQ ID NO: 739546 - protein, 115 aa, Homo sapiens [sequence omitted]

SEQ ID NO: 739547 - protein, 88 aa, Homo sapiens
MLSPHPCDTVVFVIPSSPSHTCQSALTLLGCDLHPNSVHLHRHNTVMLSHLPTVPGLWGLVNNAGISLPTAPNELLTKQDFVTILDVN

SEQ ID NO: 739548 - protein, 292 aa, Homo sapiens
FQIFFLDATCLLNSGVVHLTCTGFQKETLTFLKKSGPSLNELIPDGYNRCLVAGLLSPRFVDVQPSSLSQEEQLEAILSAAIQTSSLGLLTGYIRRWITEEQPNSATNLRFVLEWTWNKVVLTKEEFDRLCVPLFDGSCHFMDPQTIQSIQQCYLLLSNLNIVLSCFASEAREITERGLIDLSNKFVVSHLICQYAQVVLWFSHSGLLPEGIDDSVQLSRLCYNYPVIQNYYTSRRQKFERLSRGKWNPDCLMIDGLVSQLGERIEKLWIRDEGGTGKYPPASLHRILICTY

SEQ ID NO: 739549 - protein, 117 aa, Homo sapiens
PYDPRLLGSREAAVTNLNVPTNPYLLSSSGGARHGCCLQSSLLIHTAKLKTFAPVSPYKCIYKQNLISVGFKSSQNHLSYILESPRGEEHKESVDYNKDNSRVHISGVWGKKAICFV

SEQ ID NO: 739550 - protein, 107 aa, Homo sapiens [sequence omitted]

SEQ ID NO: 739551 - protein, 107 aa, Homo sapiens [sequence omitted]

SEQ ID NO: 739552 - protein, 179 aa, Homo sapiens
MSGGTSGRTRRGGRGDEQTERAERRHGHRGAANGNGAAPREEDRRSGRSGGEGERGKTGRTQRAAQRREATAAEQRRRAAGSRGHAVPPASGAQAPSANRRGTNRREAEKREERTANGSTRGAKDGTARGAQPRRDRPRTARGTGGRWGARRAAARPRAARPAPAPPRATPPGGTTGDD

SEQ ID NO: 739553 - protein, 459 aa, Homo sapiens
MRAQIEVIPCKICGDKSSGIHYGVITCEGCKGFFRRSQQNNASYSCPRQRNCLIDRTNRNRCQHCRLQKCLALGMSRDAVKFGRMSKKQRDSLYAEVQKHQQRLQEQRQEQSGEAERLARVYSSSISNGLSNLNNETSGTYANGSVIDLPKSEGYYNVDSGQPSPDQSGLDMTGIKQIKQEPIYDLTSVPNLFTYSSFNNGQLAPGITMTEIDRIAQNIIKSHLETCQYTMEELHQLAWQTHTYEEIKAYQSKSREALWQQCAIQITHAIQYVVEFAKRITGFMELCQNDQILLLKSGCLEVVLVRMCRAFNPLNNTVLFEGKYGGMQMFKALGSDDLVNEAFDFAKNLCSLQLTEEEIALFSSAVLISPDRAWLIEPRKVQKLQEKIYFALQHVIQKNHLDDETLAKLIAKIPTITAVCNLHGEKLQVFKQSHPEIVNTLFPPLYKELFNPDCATGCK

SEQ ID NO: 739554 - protein, 848 aa, Homo sapiens
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECCTPPAVFAGSPEVLHAQELEASNCDGSRDDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 739555 - protein, 68 aa, Homo sapiens
YGRMETVEIGRTPQKLEIMENDAEGAEEAALETLQKTSVLQRPYHCEACGKDFLFTPTEVLRHRKQHV

SEQ ID NO: 739556 - protein, 1168 aa, Homo sapiens
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVVYQPQEAEPTTSKSEKLDPRPFLRVLESIDHKYPPEERGDLLVFLSGMAEISAVLEAAQTYASHTQRWVVLPLHSALSVADQDKVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRGMAACWESHSDLADLLVRARPPKPCHDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 739557 - protein, 637 aa, Homo sapiens
MKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRGMAACWESHSDLADLLVCARPPKPCHDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 739558 - protein, 914 aa, Homo sapiens
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVVYQPQEAEPTTSKSEKLDPRPFLRVLESIDHKYPPEERGDLLVFLSGMAEISAVLEAAQTYASHTQRWVVLPLHSALSVADQDKVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQISTRRQALRVLTTAFRGARGVAPELGQMGGAGPKELANSSRRFAGTALGGRPPTPVTVATGPPGGGAKEEQEAPKQKDMEKAETEKR

SEQ ID NO: 739559 - protein, 1168 aa, Homo sapiens
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVVYQPQEAEPTTSKSEKLDPRPFLRVLESIDHKYPPEERGDLLVFLSGMAEISAVLEAAQTYASHTQRWVVLPLHSALSVADQDKVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRGMAACWESHSDLADLLVCARPPKPCHDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 739560 - protein, 597 aa, Homo sapiens
RLGVNRTRLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRGMLRAGSHIQIWLTFLSEPGPPKPCHDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 739561 - protein, 328 aa, Homo sapiens
GVIQRIPADGRQIFHTQAKQGAVLHPTCVFAGSPEVLHAQELEASNCDGSRDDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 739562 - protein, 149 aa, Homo sapiens
TIPATPHLPGLFGSSTLSPHPTKGGYAVTDFLTYNCLTVSMNPPSLKVGFQEDPTTPFHLSPGHSSQVGPVALRASGKGPGGALGWWVALGGGPALTAGLPQNDTDLYSDCLRTFWTCPHCGLHAPLTPLERIAHENTCPQAPQDGPPG

SEQ ID NO: 739563 - protein, 114 aa, Homo sapiens
SVLLSLSLFLSLCGYVSCYFSLSCSYLCLGHLHPVVTQGCHTLGFSGGDSTGATCLHPRLAVSASQSPCLSLCLSLCLSHWQGCGVKTDLCIFINLGGLPGGGKTGFSKGQERT

SEQ ID NO: 739564 - protein, 1168 aa, Homo sapiens; identical to SEQ ID NO: 739556

SEQ ID NO: 739565 - protein, 1168 aa, Homo sapiens; identical to SEQ ID NO: 739556

SEQ ID NO: 739566 - protein, 903 aa, Homo sapiens
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVVYQPQEAEPTTSKSEKLDPRPFLRVLESIDHKYPPEERGDLLVFLSGMAEISAVLEAAQTYASHTQRWVVLPLHSALSVADQDKVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRGTVSPGGRNPHPGCEGQGYRELPGPSGWGSHTGPGWY

SEQ ID NO: 739567 - protein, 782 aa, Homo sapiens
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVVYQPQEAEPTTSKSEKLDPRPFLRVLESIDHKYPPEERGDLLVFLSGMAEISAVLEAAQTYASHTQRWVVLPLHSALSVADQDKVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQVGAMGCGVWGFTK

SEQ ID NO: 739568 - protein, 623 aa, Homo sapiens
MSHCARPIFVFLVVSRFHHVGRAGLELLTLSDLPTSAFQTAGITGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRGMAACWESHSDLADLLVCARPPKPCHDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 739569 - protein, 114 aa, Homo sapiens; identical to SEQ ID NO: 739563

SEQ ID NO: 739570 - protein, 289 aa, Homo sapiens
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQGLTVDHQCIGVCDKHLVNHYYCKRPIYEFKITWW

SEQ ID NO: 739571 - protein, 104 aa, Homo sapiens
GVAPIRPQGLKMEQPQLSFPVACLRALVISFQFPEVVPLNIGGAHFTTRLSTLRCYEDTMLAAMFSGRHYIPTDSEGRYFIDRDGTHFGYVSPSTINFVVLAGD

SEQ ID NO: 739572 - protein, 289 aa, Homo sapiens; identical to SEQ ID NO: 739570

SEQ ID NO: 739573 - protein, 141 aa, Homo sapiens
SQHQHCPCLNGSFKSAEVLFYCLFIHVCSGYSGYNPTLISRKDLVSQLLGVLTVDSFQMSALQGIVSASESHFPRGYVLPGMAHVQSRQLWMAILTQELPRLTLILGLQVASLPTLPNPAFFPSLPQVLVDAQLCAQLFSN

SEQ ID NO: 739574 - protein, 289 aa, Homo sapiens
MWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQGIEFVAAQLKSMVLTLGLIDLRLTVEQAVLLSRLEEEYQIQKWGNIEWAHDYELQELRARTAAGTLFIHLCSESTTVKHKLLKE

SEQ ID NO: 739575 - protein, 118 aa, Homo sapiens
MWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLVTSSQCEPGP

SEQ ID NO: 739576 - protein, 118 aa, Homo sapiens; identical to SEQ ID NO: 739575

SEQ ID NO: 739577 - protein, 225 aa, Homo sapiens
MQTPLVEGCAVVLSAMCQMWCPQESRAFASAPQAVTGWFLPLIQTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQGIEFVAAQLKSMVLTLGLIDLRLTVEQAVLLSRLEEEYQIQKWGNIEWAHDYELQELRARTAAGTLFIHLCSESTTVKHKLLKE

SEQ ID NO: 739578 - protein, 123 aa, Homo sapiens
VNGWEHFSSSAGFMVRLSFLLFVRYISVRDSELALSAPIQVAKYRNGHLIPLNKSLRVFHLIFQGGFEINLDHRKLKTPQAKLFTVPSEALAIAVATEWDSQQDTIKYYTMHLVTSSQCEPGP

SEQ ID NO: 739579 - protein, 247 aa, Homo sapiens
MWRSCLRLRDGGRRLLNRPAGGPSASMSPGPTIPSPARAYAPPTERKRFYQNVSITQGEDHIVQHIIGQPNPEKQGSADPGSREVSGHRHHLLTGWEEPETLVGISKELSGIQFIRMGLRKGIEFVAAQLKSMVLTLGLIDLRLTVEQAVLLSRLEEEYQGGFPCQLEKFIQPARMAWDGLTLSIKRVHQELILVTSSSSRIVNLQEVDVVRCPDSINNRIFIDKKLVSEKNPMRKCVSLYREHKGS

SEQ ID NO: 739580 - protein, 455 aa, Homo sapiens
MWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQGIEFVAAQLKSMVLTLGLIDLRPEQVEKQVHLNMRTSTDLDTQERNHRIHRQDSGQNTYDDASTYMTINEKTIAINEAMAGSTQQDRHRQGPDPFTNTSPKYIPSDIPGEKTTQTRDQKPTTGHRPWKHGKCRGPREPKKPTKQSNPDKMKGATRDNTTTRECPHGEDRSKRERTHKRDRLSEENRRDTHKEESRRETQTGTPRIEGIRRPRKENVTRTRRENDNREAEQYEKTEMRKEGNKTQKPKTLN

SEQ ID NO: 739581 - protein, 478 aa, Homo sapiens
AQEARGGDGAPFRVSHLPRPSGAMWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQGIEFVAAQLKSMVLTLGLIDLRPEQVEKQVHLNMRTSTDLDTQERNHRIHRQDSGQNTYDDASTYMTINEDHRHNEAMAGSTQQDRHRQGPDPFTNTSPKYIPSDIPGEKTTQTRDQKPTTGHRPWKHGKCRGPREPKKPTKQSNPDKMKGATRDNTTTRECPHGEDRSKRERTHKRDRLSEENRRDTHKEESRRETQTGTPRIEGIRRPRKENVTRTRRENDNREAEQYEKTEMRKEGNKTQKPKTLNR

SEQ ID NO: 739582 - protein, 106 aa, Homo sapiens [sequence omitted]

SEQ ID NO: 739583 - protein, 362 aa, Homo sapiens
MHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 739584 - protein, 467 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 739585 - protein, 322 aa, Homo sapiens
MIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 739586 - protein, 369 aa, Homo sapiens [sequence omitted]

SEQ ID NO: 739587 - protein, 467 aa, Homo sapiens; identical to SEQ ID NO: 739584

SEQ ID NO: 739588 - protein, 467 aa, Homo sapiens; identical to SEQ ID NO: 739584

SEQ ID NO: 739589 - protein, 493 aa, Homo sapiens
GLYARKFGMRGPAWAQPTPSPGPGATMWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 739590 - protein, 362 aa, Homo sapiens; identical to SEQ ID NO: 739583

SEQ ID NO: 739591 - protein, 322 aa, Homo sapiens; identical to SEQ ID NO: 739585

SEQ ID NO: 739592 - protein, 467 aa, Homo sapiens; identical to SEQ ID NO: 739584

SEQ ID NO: 739593 - protein, 290 aa, Homo sapiens
MPGGSRHDQSHQPGQLWTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 739594 - protein, 1036 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSELELYDLQILGTKPPMNSDTHRNFDPTATLRNQGDFTWNSMSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSTSSVLPAAVQACPQYPASMFTALTWRDQQGSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 739595 - protein, 974 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 739596 - protein, 765 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 739597 - protein, 227 aa, Homo sapiens
YASLTLLISTATGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVGGPSVAGHHSKLPIGFLWRQDEILVDHPLGCSAAH

SEQ ID NO: 739598 - protein, 771 aa, Homo sapiens
MSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 739599 - protein, 797 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSELELYDLQILGTKPPMNSDTHRNFDPTATLRNQGDFTWNSMSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 739600 - protein, 138 aa, Homo sapiens
SLWQKPVGTSQQQPLGLWTREFPLEGHLLTRNETFTEATPLIPEIGMLSQMMSEEHSNGDGSAQKSSMTQWKWFIEDHATQGMQRISFPLGLTLELCEKLLDSTVPNKQLSTDQTRASWFMDGNSKAQNARKNCSVSQ

SEQ ID NO: 739601 - protein, 718 aa, Homo sapiens
DAWVAIVQEKISGLSSFGIELGFFVEEYAGSKGRFPPTKRREKKSLYIATIEKGHSLVNSLIETGRIDSLGLVVVDELHMIGEGSRGATLEMTLAKILYTSKTTQIIGMSATLNNVKTYKSFFKQNIIPVNLDQYVPKVELKEYLKINDTIYEVDSKAENGMTFSRLLNYKYSDTLKKMDPDHLVALVTEVIPNYSCLVFCPSKKNCENVAEMICKFLSKEYLKHKEKEKCEVIKNLKNIGNGNLCPVLKRTIPFGVAYHHSGLTSDERKLLEEAYSTGVLCLFTCTSTLAAGVNLPARRVILRAPYVAKEFLKRNQYKQMIGRAGRAGIDTIGESILILQEKDKQQVLELITKPLENCYSHLVQEFTKGIQTLFLSLIGLKIATNLDDIYHFMNGTFFGVQQKVLLKEKSLWEITVESLRYLTEKGLLQKDTIYKSEEEVQYNFHITKLGRASFKGTIDLAYCDILYRDLKKGLEGLVLESLLHLIYLTTPYDLVSQCNPDWMIYFRQFSQLSPAEQNVAAILGVSESFIGKKASGQAIGKKVDKNVVNRLYLSFVLYTLLKETNIWTVSEKFNMPRGYIQNLLTGTASFSSCVLHFCEELEEFWVYRALLVELTKKLTYCVKAELIPLMEVTGVLEGRAKQLYSAGYKSLMHLANANPEVLVRTIDHLSRRQAKQIVSSAKMLLHEKAEALQEEVEELLRLPSDFPGAVASSTDKA

SEQ ID NO: 739602 - protein, 718 aa, Homo sapiens; identical to SEQ ID NO: 739601

SEQ ID NO: 739603 - protein, 215 aa, Homo sapiens
MIYFRQFSQLSPAEQNVAAILGVSESFIGKKASGQAIGKKVDKNVVNRLYLSFVLYTLLKETNIWTVSEKFNMPRGYIQNLLTGTASFSSCVLHFCEELEEFWVYRALLVELTKKLTYCVKAELIPLMEVTGVLEGRAKQLYSAGYKSLMHLANANPEVLVRTIDHLSRRQAKQIVSSAKMLLHEKAEALQEEVEELLRLPSDFPGAVASSTDKA

SEQ ID NO: 739604 - protein, 512 aa, Homo sapiens
DAWVAIVQEKISGLSSFGIELGFFVEEYAGSKGRFPPTKRREKKSLYIATIEKGHSLVNSLIETGRIDSLGLVVVDELHMIGEGSRGATLEMTLAKILYTSKTTQIIGMSATLNNVKTYKSFFKQNIIPVNLDQYVPKVELKEYLKINDTIYEVDSKAENGMTFSRLLNYKYSDTLKKMDPDHLVALVTEVIPNYSCLVFCPSKKNCENVAEMICKFLSKEYLKHKEKEKCEVIKNLKNIGNGNLCPVLKRTIPFGVAYHHSGLTSDERKLLEEAYSTGVLCLFTCTSTLAAGVNLPARRVILRAPYVAKEFLKRNQYKQMIGRAGRAGIDTIGESILILQEKDKQQVLELITKPLENCYSHLVQEFTKGIQTLFLSLIGLKIATNLDDIYHFMNGTFFGVQQKVLLKEKSLWEITVESLRYLTEKGLLQKDTIYKSEEEVQYNFHITKLGRASFKGTIDLAYCDILYRDLKKGLEGLVLESLLHLIYLTTPYDLVSQCNPDWMIYFRQVRI

SEQ ID NO: 739605 - protein, 181 aa, Homo sapiens
AKKKRKGKRLVSWVRFMSSDAELWSFLCSLKHQFSPHILRSKDVYGYSSCRALVPDPPGPPTARGQARRPVPRAAARRRRRGARAAAARRRKPRPPPPPPPPPEESCPAKPVAPGPCFGGRTLEEIWRAATPTLTTFPTIRVGSDVWGERSLAAARRRARQVLRVNLEPMVRLRRFPVPRA

SEQ ID NO: 739606 - protein, 186 aa, Homo sapiens
MRRSMKRRRRRRPVAPATAARGGDFRAEDGAGLEAREEKVVYSRSQLSLADSTKALGDAFKLFMPRSTEFMSSDAELWSFLCSLKHQFSPHILRSKDVYGYSSCRALVPDPPGPKPVAPGPCFGGRTLEEIWRAATPTLTTFPTIRVGSDVWGERSLAAARRRARQVLRVNLEPMVRLRRFPVPRA

SEQ ID NO: 739607 - protein, 235 aa, Homo sapiens
MRRSMKRRRRRRPVAPATAARGGDFRAEDGAGLEAREEKVVYSRSQLSLADSTKALGDAFKLFMPRSTEFMSSDAELWSFLCSLKHQFSPHILRSKDVYGYSSCRALVPDPPGPPTARGQARRPVPRAAARRRRRGARAAAARRRKPRPPPPPPPPPEESCPAKPVAPGPCFGGRTLEEIWRAATPTLTTFPTIRVGSDVWGERSLAAARRRARQVLRVNLEPMVRLRRFPVPRA

SEQ ID NO: 739608 - protein, 236 aa, Homo sapiens
WALSGYVSRACWVRSNFMKRRRRRRPVAPATAARGGDFRAEDGAGLEAREEKVVYSRSQLSLADSTKALGDAFKLFMPRSTEFMSSDAELWSFLCSLKHQFSPHILRSKDVYGYSPTARGQARRPVPRAAARRRRRGARAAAARRRKPRPPPPPPPPPEESCPAKPVAPGPCFGGRTLEEIWRAATPTLTTFPTIRVGSDVWGERSLAAARRRARQVLRVNLEPMVRLRRFPVPRA

SEQ ID NO: 739609 - protein, 151 aa, Homo sapiens [sequence omitted]

SEQ ID NO: 739610 - protein, 643 aa, Homo sapiens
MLLGASLVGVLLFSKLVLKLPWTQVGFSLLFLYLGSGGWRFIRVFIKTIRRDIFGGLVLLKVKAKVRQCLQERRTVPILFASTVRRHPDKTALIFEGTDTHWTFRQLDEYSSSVANFLQARGLASGDVAAIFMENRNEFVGLWLGMAKLGVEAALINTNLRRDALLHCLTTSRARALVFGSEMASAICEVHASLDPSLSLFCSGSWEPGAVPPSTEHLDPLLKDAPKHLPSCPDKGFTDKLFYIYTSGTTGLPKAAIVVHSRYYRMAALVYYGFRMRPNDIVYDCLPLYHSAGNIVGIGQCLLHGMTVVIRKKFSASRFWDDCIKYNCTIVQYIGELCRYLLNQPPREAENQHQVRMALGNGLRQSIWTNFSSRFHIPQVAEFYGATECNCSLGNFDSQVGACGFNSRILSFVYPIRLVRVNEDTMELIRGPDGVCIPCQPGEPGQLVGRIIQKDPLRRFDGYLNQGANNKKIAKDVFKKGDQAYLTGDVLVMDELGYLYFRDRTGDTFRWKGENVSTTEVEGTLSRLLDMADVAVYGVEVPGTEGRAGMAAVASPTGNCDLERFAQVLEKELPLYARPIFLRLLPELHKTGTYKFQKTELRKEGFDPAIVKDPLFYLDAQKGRYVPLDQEAYSRIQAGEEKL

SEQ ID NO: 739611 - protein, 643 aa, Homo sapiens; identical to SEQ ID NO: 739610

SEQ ID NO: 739612 - protein, 616 aa, Homo sapiens
MLLGASLVGVLLFSKLVLKLPWTQVGFSLLFLYLGSGGWRFIRVFIKTIRRDIFGGLVLLKVKAKVRQCLQERRTVPILFASTVRRHPDKTALIFEGTDTHWTFRQLDEYSSSVANFLQARGLASGDVAAIFMENRNEFVGLWLGMAKLGVEAALINTNLRRDALLHCLTTSRARALVFGSEMASAICEVHASLDPSLSLFCSGSWEPGAVPPSTEHLDPLLKDAPKHLPSCPDKGFTDKLFYIYTSGTTGLPKAAIVVHSRYYRMAALVYYGFRMRPNDIVYDCLPLYHSAGNIVGIGQCLLHGMTVVIRKKFSASRFWDDCIKYNCTIVQYIGELCRYLLNQPPREAENQHQVRMALGNGLRQSIWTNFSSRFHIPQVAEFYGATECNCSLGNFDSQVGACGFNSRILSFVYPIRLVRVNEDTMELIRGPDGVCIPCQPGEPGQLVGRIIQKDPLRRFDGYLNQGANNKKIAKDVFKKGDQAYLTGDVLVMDELGYLYFRDRTGDTFRWKGENVSTTEVEGTLSRLLDMADVAVYGVEVPGTEGRAGMAAVASPTGNCDLERFAQVLEKELPLYARPIFLRLLPELHKTDAQKGRYVPLDQEAYSRIQAGEEKL

SEQ ID NO: 739613 - protein, 107 aa, Homo sapiens
MPRRAATSRWTKRPTAASRQARRSCDSPHPSEGRRMLDPEPQVPPQSGPGQGQTKASRAWHLHPEVLPLHPKLPSDSLPSQPFQRLSVKVSCPSSVFWAGQALWFPG

SEQ ID NO: 739614 - protein, 148 aa, Homo sapiens
GVSHCARPRFGGHHSVAALPHLQQPQPARREPSLWQRQQEKERKRNPGLGSRQSCPQSLCGAAKAPLLSQHPWSPFQMKPGELSTATNTPGKRRGQSPWLPQRAQPDPFIQGPQAMFVRFCFFPFEKKGCWFGFQFYCRHTERPLSGS

SEQ ID NO: 739615 - protein, 76 aa, Homo sapiens
DGAGLLRTRSTVSAFFASTVLTRNRIPTATASRKRLQGGRDLWRDAPFPASRPAELGFSVSIRWYTKCLPPTPSCP

SEQ ID NO: 739616 - protein, 73 aa, Homo sapiens
ATPRTKRLAKKNAGEVQHPRTERELIPEGGFTGLRVLGWGKQYWREKTEGMARQRKPRGQKGRDEEPSYYKRD

SEQ ID NO: 739617 - protein, 105 aa, Homo sapiens
MSVGLCFLIWQMGIMLLPRECWKVKDSKKYKSCRESVLPAQACTGESPVLSGVRVLGIHLSCVLSHLQAWDSWDNQKVSYLGAPCFGKRLSPTTWLTFWVGPLAF

SEQ ID NO: 739618 - protein, 126 aa, Homo sapiens
NEGEWKLRVHPTAQAVPDLSLTASARATYQVLFLDLCPRVSLGHLGCGLGTIHSLIKQEPHPQGSLPRLPHTLAPGEGSVAEGLIGARHCSRPSGIWHLSKFAKRRVQWFTPVIPAFWEAKVGGLL

SEQ ID NO: 739619 - protein, 171 aa, Homo sapiens
WNCIQRRQRRLRRPREGIPLGILPHTEEYVFGSTPNHIMAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPVSIF

SEQ ID NO: 739620 - protein, 617 aa, Homo sapiens
WNCIQRRQRRLRRPREGIPLGILPHTEEYVFGSTPNHIMAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 739621 - protein, 176 aa, Homo sapiens
MELIMAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKALPVLKR

SEQ ID NO: 739622 - protein, 224 aa, Homo sapiens
MAKPRLYKKIQKLAGCGGSVPVVSATWETEHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVWLCDMFKIKTPCTVDPCILICL

SEQ ID NO: 739623 - protein, 280 aa, Homo sapiens
WNCIQRRQRRLRRPREGIPLGILPHTEEYVFGSTPNHIMAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPGSTIQPPSERGSLLLSRPDLLAPGEDPPVSASLTLERQKGESLLAWSWSLNFRLPGIPITVQKKRRDLKKLAAVMRQVRQWESHPLQNIEEATWHQLTVQAEKKEPGTQGASV

SEQ ID NO: 739624 - protein, 461 aa, Homo sapiens
WNCIQRRQRRLRRPREGIPLGILPHTEEYVFGSTPNHIMAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKRV

SEQ ID NO: 739625 - protein, 456 aa, Homo sapiens
WNCIQRRQRRLRRPREGIPLGILPHTEEYVFGSTPNHIMAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNRRSMMMDCVFRSRSRRP

SEQ ID NO: 739626 - protein, 210 aa, Homo sapiens
WNCIQRRQRRLRRPREGIPLGILPHTEEYVFGSTPNHIMAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKALPVLKR

SEQ ID NO: 739627 - protein, 653 aa, Homo sapiens
WNCIQRRQRRLRRPREGIPLGILPHTEEYVFGSTPNHIMAVFNQKSVSDMIKEFRKNWRALCNSERTTLCGADSMLLALQLSMAENNKQRDGVSPCKPGWSRSPDFVIHPPSASQSAKITGVNIHHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 739628 - protein, 552 aa, Homo sapiens
SAQARRGGRGAGLLEAAAVASAAAPAVFSGLRRVKSGLGPRLEGWVGPERRFGGPRRTREGENLRSWVAIRGLLRSYLQAAVTALSLEWKLLEGGPAAMSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 739629 - protein, 510 aa, Homo sapiens
RLGVESAEGVPAAVWRRPYSPGCGGVAIRGLLRSYLQAAVTALSLEWKLLEGGPAAMSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 739630 - protein, 519 aa, Homo sapiens
RRRRRVAAAGARGFWRRRRWPARRRRPYSPGCGGVAIRGLLRSYLQAAVTALSLEWKLLEGGPAAMSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 739631 - protein, 650 aa, Homo sapiens
RLGVESAEGVPAAVWRRPYSPGCGGVAIRGLLRSYLQAAVTALSLEWKLLEGGPAAMSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKVSGEVGELPGLPALAFSLGSRGPSAFKACGCDNPQWLGRVPRGVSLCGGGWVLGVGCPAPDRPGGILGWCVSNGADSWGQGRSVFLERALSALRRAGQSPSRGVDSAPDEPLNLSSHWQVGAGGAGWHRGDPAQASLLPMAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 739632 - protein, 429 aa, Homo sapiens
CLALRTPVDGTQLRRLQPSQDAQLAGAHGAQEPVPAMAPCLRPKRPLAWRTERPRRSRPQGGWLEETSPRTQPDPKDTASPQDTASPQDTASPQDTGECLDFVETAPQALPWEVNEPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 739633 - protein, 378 aa, Homo sapiens
RQTLLGPLTAGLLTLILWLRCWLGLPTAVTLPSALLSTGGFRALRLHRYFESPRRLLPVHFCCCQWRGGGVDFECLLGGVWDRCRKVLRAQECEWPRHLPSACLLCSACRGQPERRAAVVGAQDPTEPPRLSRSLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 739634 - protein, 373 aa, Homo sapiens
MTLRRAATISKDILLNACLVPWLFVFAYSMTSQHGTESYEMNAEQMNVARPTELMAALELWCSVASIRSDVPGDTVRVFATILSVHHIESIVESHFADESKSLNRYGAGMGDGGSSQYAFTYMVLLMLRRDWFRTTLCETLTTISDVTDSVRARNVLCRTRSQLMLAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 739635 - protein, 191 aa, Homo sapiens
RLGVESAEGVPAAVWRRPYSPGCGGVAIRGLLRSYLQAAVTALSLEWKLLEGGPAAMSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQTPGDPHRRRPCSA

SEQ ID NO: 739636 - protein, 98 aa, Homo sapiens
VESDSFVVGEGGSVFCQKASDCTDNSAGCCLLLPLAQEEVVGRGGWDGRRTGSPHAAGWRRAWWGLPLCALLAEAGPPGVGCPAADSSASPIVAPVDA

SEQ ID NO: 739637 - protein, 111 aa, Homo sapiens
HRTETRAPRRIPTCAPAPRAELPDRGPPPAPTMYAFVRFLEDNVCYALPVSCVRDFSPRSRLDFDNQKVYAVYRGPEELGAGPESPPRAPRDWGALLLHKAQILALDRRQI

SEQ ID NO: 739638 - protein, 158 aa, Homo sapiens
HRTETRAPRRIPTCAPAPRAELPDRGPPPAPTMYAFVRFLEDNVCYALPVSCVRDFSPRSRLDFDNQKVYAVYRGPEELGAGPESPPRAPRDWGALLLHKAQILALAEDKSDLENSVMQKKIKIPKLSLNHVEEDGEVKDYGEEDLQLRHIKDCLGKY

SEQ ID NO: 739639 - protein, 389 aa, Homo sapiens
DNQKVYAVYRGPEELGAGPESPPRAPRDWGALLLHKAQILALAEDKSDLENSVMQKKIKIPKLSLNHVEEDGEVKDYGEEDLQLRHIKRPEGRKPSEVAHKSIEAVVARLEKQNGLSLGHSTCPEEVFVEASPGTEDMDSLEDAVVPRALYEELLRNYQQQQEEMRHLQQELERTRRQLVQQAKKLKEYGALVSEMKELRDLNRRLQDVLLLRLGSGPAIDLEKVKSECLEPEPELRSTFSEEANTSSYYPAPAPVMDKYILDNGKVHLGSGIWVDEEKWHQLQVTQGDSKYTKNLAVMIWGTDVLKNRSVTGVATKKKKDAVPKPPLSPHKLSIVRECLYDRIAQETVDETEIAQRLSKVNKYICEKIMDINKSCKNEERREAKYNLQ

SEQ ID NO: 739640 - protein, 318 aa, Homo sapiens
DNQKVYAVYRGPEELGAGPESPPRAPRDWGALLLHKAQILALAEDKSDLENSVMQKKIKIPKLSLNHVEEDGEVKDYGEEDLQLRHIKRPEGRKPSEVAHKSIEAVVARLEKQNGLSLGHSTCPEEVFVEASPGTEDMDSLEDAVVPRALYEELLRNYQQQQEEMRHLQQELERTRRQLVQQAKKLKEYGALVSEMKELRDLNRRLQDVLLLRLGSGPAIDLEKVKSECLEPEPELRSTFSEEANTSSYYPAPAPVMDKYILDNGKVHLGSGIWVDEEKWHQLQVTQGDSKYTKNLAVMIWGQKRHRRRHKKKERCSP

SEQ ID NO: 739641 - protein, 225 aa, Homo sapiens
DNQKVYAVYRGPEELGAGPESPPRAPRDWGALLLHKAQILALAEDKSDLENSVMQKKIKIPKLSLNHVEEDGEVKDYGEEDLQLRHIKRPEGRKPSEVAHKSIEAVVARLEKQNGLSLGHSTCPEEVFVEASPGTEDMDSLEDAVVPRALYEELLRNYQQQQEEMRHLQQELERTRRQLVQQAKKLKEYGALVSEMKELRDLNRRLQDVLLLRLGSGPSGKRDLG

SEQ ID NO: 739642 - protein, 261 aa, Homo sapiens
MGMLNLEIGGDAGGRIGCKELVLMEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 739643 - protein, 238 aa, Homo sapiens
MEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 739644 - protein, 112 aa, Homo sapiens
MEEQDARVPALEPFRVEQAPPVIYYVPDFISKEEEEYLLRQVFNAPKPKWTQLSGRKLQNWGGPSGPHCLPQVGFLIPEGWFLSGCPHGSSATWTKCQTSASLEASQLTMSS

SEQ ID NO: 739645 - protein, 127 aa, Homo sapiens [sequence omitted]

SEQ ID NO: 739646 - protein, 217 aa, Homo sapiens
MGMLNLEIGGDAGGRIGCKELVLMEEQDARVPALEPFRVEQAPPVIYYVPDFISKEEEEYLLRQVTSVPYWFLMPQSQSGPSSLGESYRTGPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 739647 - protein, 190 aa, Homo sapiens
MEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMPHEDGPLYYPTVSTISLGSHTVLDFYEPRRPEDDDPTEQPRPPPRPTTSLCAPASCWASDRQGRDPSDSQVPAPLGLL

SEQ ID NO: 739648 - protein, 169 aa, Homo sapiens
MVPERLPPWLQRYVDKVSNLSLFGGLPANHVLVNQYLPGEGIMPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 739649 - protein, 126 aa, Homo sapiens
MEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMVTTHPRPVSPHSDF

SEQ ID NO: 739650 - protein, 133 aa, Homo sapiens
MEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMHHQPGLPHRAGLLRAAAARGR

SEQ ID NO: 739651 - protein, 163 aa, Homo sapiens
MSLTSSPKKRRSICFDRFLMPQSQSGPSSLGESYRTGPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 739652 - protein, 63 aa, Homo sapiens
SHTVLDFYEPRRPEDDDPTEQVGPQTLPQLLVGTSTSHILQDDLVPHAFGVLLALSQIPSLVP

SEQ ID NO: 739653 - protein, 32 aa, Homo sapiens
MATQPPRLLWAKLREFPLKLELFPQIQDPIGH

SEQ ID NO: 739654 - protein, 340 aa, Homo sapiens
MQGGEPVSTMKVSESEGKLEGQATAVTPNKNSSCGGGISSSSSSRGGSAKGWQYSDHMENVYGYLMKYTNLVTGWQYRFFVLNNEAGLLEYFVNEQSRNQKPRGTLQLAGAVISPSDEDSHTFTVNAASGEQYKLRATDAKERQHWVSRLQICTQHHTEAIGKNNPPLKSRSFSLASSSNSPISQRRPSQNAISFFNVGHSKLQSLSKRTNLPPDHLVEVREMMSHAEGQQRDLIRRIECLPTSGHLSSLDQDLLMLKATSMATMNCLNDCFHILQLQHASHQKGSLPSGTTIEWLEPKISLSNHYKNGADQPFATDQSKPVAVPEEQPVAESGLLARVR

SEQ ID NO: 739655 - protein, 295 aa, Homo sapiens
EQWSEQVVYSDHMENVYGYLMKYTNLVTGWQYRFFVLNNEAGLLEYFVNEQSRNQKPRGTLQLAGAVISPSDEDSHTFTVNAASGEQYKLRATDAKERQHWVSRLQICTQHHTEAIGKNNPPLKSRSFSLASSSNSPISQRRPSQNAISFFNVGHSKLQSLSKRTNLPPDHLVEVREMMSHAEGQQRDLIRRIECLPTSGHLSSLDQDLLMLKATSMATMNCLNDCFHILQLQHASHQKGSLPSGTTIEWLEPKISLSNHYKNGADQPFATDQSKPVAVPEEQPVAESGLLARVR

SEQ ID NO: 739656 - protein, 90 aa, Homo sapiens
REERTLGTGGEGIMSWGWEQSQEESSAWSRQTPTPQLETQEPHSPHSNKKHQLLVPKKGGPQLQGLRPALELRTRGLQGEDRASGTREPL

SEQ ID NO: 739657 - protein, 1016 aa, Homo sapiens
RGLRWAGRRGTEAAAAAAAAGNRGSAPPARDPIPIPVPAERSPGPDMDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 739658 - protein, 1041 aa, Homo sapiens
RGLRWAGRRGTEAAAAAAAAGNRGSAPPARDPIPIPVPAERSPGPDMDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPGEAEAGKVRMGQGRAPGTPDPVSLQDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 739659 - protein, 950 aa, Homo sapiens
RGLRWAGRRGTEAAAAAAAAGNRGSAPPARDPIPIPVPAERSPGPDMDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQEGGCTIYGKQDVCQQPGHCVWADTAAAAGGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 739660 - protein, 922 aa, Homo sapiens
RGLRWAGRRGTEAAAAAAAAGNRGSAPPARDPIPIPVPAERSPGPDMDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEVRTHWAHSYGEGLISVQFSYLLFHLPSFLKFPSFSSSLPHLTYVHSGRNSEE

SEQ ID NO: 739661 - protein, 165 aa, Homo sapiens
MLLPQGLCTGYSFCMSRNKPLALQESQRTGILVLGSHSWVSPCRFQLHRVTRERTWLKTPKMGEGKVSMLERGSGVLGVPWPQGGLLKDDSWGDIQRTWRCSALTTHPVHSVQPRPRGLTPGDTVSWPLQPPASEVSPGRCEACNPPAVQSGPGGFQAVRGDPHH

SEQ ID NO: 739662 - protein, 1016 aa, Homo sapiens; identical to SEQ ID NO: 739657

SEQ ID NO: 739663 - protein, 849 aa, Homo sapiens
MPRPGAAMPRNCLPGLKREPAMSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 739664 - protein, 925 aa, Homo sapiens
RGLRWAGRRGTEAAAAAAAAGNRGSAPPARDPIPIPVPAERSPGPDMDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEGSTLVSDTWDRGAFATLVVVTPPHLPASFTDSK

SEQ ID NO: 739665 - protein, 124 aa, Homo sapiens
VSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 739666 - protein, 178 aa, Homo sapiens
MGNSLLRENRRQQNTQEMPWNVRMQSPKQRTSRCWDHHIAEGCFCLPWKKILIFEKRQDSQNENERMSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 739667 - protein, 161 aa, Homo sapiens
MPWNVRMQSPKQRTSRCWDHHIAEGCFCLPWKKILIFEKRQDSQNENERMSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 739668 - protein, 112 aa, Homo sapiens
MSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 739669 - protein, 212 aa, Homo sapiens
SGRVRAPSRARGAAGAGARMLEVHIPSVGPEAEGPRQSPEKSHMVFRVEVLCSGRRHTVPRRYSEFHALHKRIKKLYKVPDFPSKRLPNWRTRGLEQRRQGLEAYIQGILYLNQEVPKELLEFLRLRHFPTDPKASNWGTLREFLPGDSSSQQHQRPVLSFHVDPYVCNPSPESLPNVVVNGVLQGLYSFSISPDKAQPKAACHPAPLPPMP

SEQ ID NO: 739670 - protein, 152 aa, Homo sapiens
MLEVHIPSVGPEAEGPRQSPEKSHMVFRVEVLCSGRRHTVPRRYSEFHALHKRVRRRRPPTGPGPASVQPPPRPCEAGGRAPASATPITASVPAQPVSPRASVGGLGPSSPSAGPPLTRVCPSRARRRGRGRASGWGEEGLRAQSGCCDRTR

SEQ ID NO: 739671 - protein, 228 aa, Homo sapiens
SGRVRAPSRARGAAGAGARMLEVHIPSVGPEAEGPRQSPEKSHMVFRVEVLCSGRRHTVPRRYSEFHALHKRIKKLYKVPDFPSKRLPNWRTRGLEQRRQGLEAYIQGILYLNQEVPKELLEFLRLRHFPTDPKASNWGYRGADGGGQGLSAVSSTLREFLPGDSSSQQHQRPVLSFHVDPYVCNPSPESLPNVVVNGVLQGLYSFSISPDKAQPKAACHPAPLPPMP

SEQ ID NO: 739672 - protein, 207 aa, Homo sapiens
ARGAAGAGARMLEVHIPSVGPEAEGPRQSPEKSHMVSAAPGWGGAPGPAGFPRRRSVGTGAPGLGERALRAGPSGETLSRVWGPLGFASSRTMVRALEGPQGSEGQVRQPVLPGVRERRVPGQPRRRKAALCLGEREGGHVARRRCCGVLPRGLTRRPAARPRRQVFRVEVLCSGRRHTVPRRYSEFHALHKRVRRRRPPTGPGPAS

SEQ ID NO: 739673 - protein, 152 aa, Homo sapiens; identical to SEQ ID NO: 739670

SEQ ID NO: 739674 - protein, 212 aa, Homo sapiens; identical to SEQ ID NO: 739669

SEQ ID NO: 739675 - protein, 195 aa, Homo sapiens
MGRARDAILDALENLTAEELKKFKLKLLSVPLREGYGRIPRGALLSMDALDLTDKLVSFYLETYGAELTANVLRDMGLQEMAGQLQAATHQGSGAAPAGIQAPPQSAAKPGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 739676 - protein, 231 aa, Homo sapiens
MSPSAAPSRVPPRRPAGGRDPGVPRRPGAPIQRPGWEGTKGVVRKRLLLEGNGPGRGVGRPEWEEGGESRFRPGADFLLVGGCSGVSGGSGRGSWSHGARARRHPGCAGEPDRRGAQEVQLQAATHQGSGAAPAGIQAPPQSAAKPGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 739677 - protein, 176 aa, Homo sapiens
MGRARDAILDALENLTAEELKKFKLKLLSVPLREGYGRIPRGALLSMDALDLTDKLVSFYLETYGAELTANVLRDMGLQEMAGQLQAATHQGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 739678 - protein, 149 aa, Homo sapiens
MDALDLTDKLVSFYLETYGAELTANVLRDMGLQEMAGQLQAATHQGSGAAPAGIQAPPQSAAKPGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 739679 - protein, 226 aa, Homo sapiens
MGRARDAILDALENLTAEELKKFKLKLLSVPLREGYGRIPRGALLSMDALDLTDKLVSFYLETYGAELTANVLRDMGLQEMAGQLQAATHQGGSPRLAYRPTGPRPHGGKGREGDHLAHILPGSGAAPAGIQAPPQSAAKPGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 739680 - protein, 176 aa, Homo sapiens; identical to SEQ ID NO: 739677

SEQ ID NO: 739681 - protein, 231 aa, Homo sapiens; identical to SEQ ID NO: 739676

SEQ ID NO: 739682 - protein, 113 aa, Homo sapiens
WCWCETEELRILLGLVGSALHCLELDLQGLAPPGPKGVPVLPGGGPGAELRLLPSNTPVSPWQSHQIILNLIFLYTIYEKPACELVCFPASSLLACAELSYASEATQPPAPCP

SEQ ID NO: 739683 - protein, 341 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 739684 - protein, 264 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEDCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 739685 - protein, 260 aa, Homo sapiens
MNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 739686 - protein, 317 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRNGLQLIFIFIWSFQ

SEQ ID NO: 739687 - protein, 398 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGQGNAQAFLYSGNPGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKADSSSQQSSRIPSQTLYPQDYSHCLGRLGGLPSRTLGAGVSSFGQGNPGAK

SEQ ID NO: 739688 - protein, 355 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGQGNAQAFLYSGNPGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 739689 - protein, 286 aa, Homo sapiens
MQEGELAISPISPVAAMPPLGTHVQARCEAQINLLGEGGICKLPGRLRDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 739690 - protein, 262 aa, Homo sapiens
MQEGELAISPISPVAAMPPLGTHVQARCEAQINLLGEGGICKLPGRLRDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRNGLQLIFIFIWSFQ

SEQ ID NO: 739691 - protein, 148 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEAPPL

SEQ ID NO: 739692 - protein, 112 aa, Homo sapiens
GKRPPRNHLVMAMVFPEEQSSHLNTVPSTAFLTAPRVPPGPLYHFYSPQDQAHSSLLGKDSRAGPAGRRRHPQPSVIKSTARPKPVISQQSAHSKVLGHQTILSLNRGRENV

SEQ ID NO: 739693 - protein, 1524 aa, Homo sapiens
MAAVYSGISLKLKSKTTSWEDKLKLAHFAWISHQCFLPNKEQVLLDWARQSLVAFYKKKLELKEDIVERLWIYIDNILHSRKLQNLLKNGKTINLQISLVKIINERVAEFSLSGSQRNICAVLRCCQGILSTPALAVIYTAKQELMVALLSQLCWSACRQPEGAVVAQLFEVIHLALGHYLLILQQQVNPRRAFGDVTAHLLQPCLVLRHLLSGGTWTQAGQGQLRQVLSRDIRSQIEAMFRGGIFQPELLSSYKEGLLDQQQGDVKTGAMKNLLAPMDTVLNRLVDAGYCAASLHTSVVANSVALLYKLFLDSYFKEGNQLLCFQVLPRLFGCLKISHLQEEQSKALSTSDWTTELLVVEQLLNSVANNNIYNIAADRIRHEEAQFRFYRHVAELLINHAQAPIPAWFRCLKTLISLNHLILEPDLDDLLASAWIDAEVTEFRTKKAQEALIRTVFQTYAKLRQVPRLFEEVLGVICRPAAEALRQPVLASGPSTVLSACLLELPPSQILDTWSLVLEKFQSLVLPYLQSDADMALKLLSLSLLLHCIMFNMRSLDSSTPLPIVRRTQCMMERMMRELVQPLLALLPDTPGPEPELWLQKVSDSVLLLSYTWAQVDAMFSLNCSQYHSMSGPLIGVALEISNLPSLLPGVKTQHWKKIEKFTAQFSSLGTYCLEQLYLQKMKRTLMQTSFRSEGAIQSLRCDAAFIIGSGRKSLNQRTTASWDGQVGMVSGLTYPVAHWHLIVSNLTILISYLCPDDVGYLASVLLRTLPMGKAQEVSIDEEAYITLEKISKAFLHSPLFPEMQSLHSAFLTCVTTSCSSILCSGAQRDSGLVSQQLPWLFEKDHMVVGHWENRFAKAGPEGIEPRGEIAQNLLSLVKSDFPIQLEGEQLESILGLLEVISALQLDSLLPPYHVHYFLVLLSMAVTKLGCSCSSSLALKFLTTCYQLLGYLQKGKSARSVFKIMYGSDIFEVVLTSLFRASSRFLIEMDDPAWLEFLQVIGTFLEELMQMLIQMKLSLVLNFRKITAFLSSSKPYTEAASSKQLENQNPQGRQLLLVSLTRLCHVLGPFLKEQKLGQEAPAALSELLQQVVLQTGAVLQLCSVPGARGWRLPSVLISSVSTLLEADLGQHCRDGGADISQGSDRTLLSHVALYQGVYSQILLELPALAGHDQSFQAALQFLTLFFLAPELHPKKDSVFTSMFHSVRRVLADPEIPVQVTQDIEPHLGALFTQMLEVGTTEDLRLVMQCILQGLDVSNMWKADVQAVVSAVTLLRLLLNCPLSGEKASLLWRACPQIVTALTLLNREASQEQPVSLTVVGPVLDVLAALLRQGEEAIGNPHHVSLAFSILLTVPLDHLKPLEYGSVFPRLHNVLFSILQCHPKVMLKAIPSFLNSFNRLVFSVMREGRQKDKGSIDDLPTVLKCARLVERMYSHIAARAEEFAVFSPFMVAQYVLEVQKVTLYPAVKSLLQEGIYLILDLCIEPDVQFLRASLQPGMRDIFKELYNDYLKYHKAKHEGEKRYTA

SEQ ID NO: 739694 - protein, 1524 aa, Homo sapiens; identical to SEQ ID NO: 739693

SEQ ID NO: 739695 - protein, 140 aa, Homo sapiens [sequence omitted]

SEQ ID NO: 739696 - protein, 1524 aa, Homo sapiens; identical to SEQ ID NO: 739693

SEQ ID NO: 739697 - protein, 1506 aa, Homo sapiens
MAAVYSGISLKLKSKTTSWEDKLKLAHFAWISHQCFLPNKEQVLLDWARQSLVAFYKKKLELKEDIVERLWIYIDNILHSRKLQNLLKNGKTINLQISLVKIINERVAEFSLSGSQRNICAVLRCCQGILSTPALAVIYTAKQELMVALLSQLCWSACRQPEGAVVAQLFEVIHLALGHYLLILQQQVNPRRAFGDVTAHLLQPCLVLRHLLSGGTWTQAGQGQLRQVLSRDIRSQIEAMFRGGIFQPELLSSYKEGLLDQQQGDVKTGAMKNLLAPMDTVLNRLVDAGYCAASLHTSVVANSVALLYKLFLDSYFKEGNQLLCFQVLPRLFGCLKISHLQEEQSKALSTSDWTTELLVVEQLLNSVANNNIYNIAADRIRHEEAQFRFYRHVAELLINHAQAPIPAWFRCLKTLISLNHLILEPDLDDLLASAWIDAEVTEFRTKKAQEALIRTVFQTYAKLRQVPRLFEEVLGVICRPAAEALRQPVLASGPSTVLSACLLELPPSQILDTWSLVLEKFQSLVLPYLQSDADMALKLLSLSLLLHCIMFNMRSLDSSTPLPIVRRTQCMMERMMRELVQPLLALLPDTPGPEPELWLQKVSDSVLLLSYTWAQVDAMFSLNCSQYHSMSGPLIGVALEISNLPSLLPGVKTQHWKKIEKFTAQFSSLGTYCLEQLYLQKMKRTLMQTSFRSEGAIQSLRCDAAFIIGSGRKSLNQRTTASWDGQVGMVSGLTYPVAHWHLIVSNLTILISYLCPDDVGYLASVLLRTLPMGKAQEVSIDEEAYITLEKISKAFLHSPLFPEMQSLHSAFLTCVTTSCSSILCSGAQRDSGLVSQQLPWLFEKDHMVVGHWENRFAKAGPEGIEPRGEIAQNLLSLVKSDFPIQLEGEQLESILGLLEVISALQLDSLLPPYHVHYFLVLLSMAVTKLGCSCSSSLALKFLTTCYQLLGYLQKGKSARSVFKIMYGSDIFEVVLTSLFRASSRFLIEMDDPAWLEFLQVIGTFLEELMQMLIQMKLSLVLNFRKITAFLSSSKPYTEAASSKQLENQNPQGRQLLLVSLTRLCHVLGPFLKEQKLGQEAPAALSELLQQVVLQTGAVLQLCSVPGARGWRLPSVLISSVSTLLEADLGQHCRDGGADISQGSDRTLLSHVALYQGVYSQILLELPALAGHDQSFQAALQFLTLFFLAPELHPNPEIPVQVTQDIEPHLGALFTQMLEVGTTEDLRLVMQCILQGLDVSNMWKADVQAVVSAVTLLRLLLNCPLSGEKASLLWRACPQIVTALTLLNREASQEQPVSLTVVGPVLDVLAALLRQGEEAIGNPHHVSLAFSILLTVPLDHLKPLEYGSVFPRLHNVLFSILQCHPKVMLKAIPSFLNSFNRLVFSVMREGRQKDKGSIDDLPTVLKCARLVERMYSHIAARAEEFAVFSPFMVAQYVLEVQKVTLYPAVKSLLQEGIYLILDLCIEPDVQFLRASLQPGMRDIFKELYNDYLKYHKAKHEGEKRYTA

SEQ ID NO: 739698 - protein, 1475 aa, Homo sapiens
MAAVYSGISLKLKSKTTSWEDKLKLAHFAWISHQCFLPNKEQVLLDWARQSLVAFYKKKLELKEDIVERLWIYIDNILHSRKLQNLLKNGKTINLQISLVKIINERVAEFSLSGSQRNICAVLRCCQGILSTPALAVIYTAKQELMVALLSQLCWSACRQPEGAVVAQLFEVIHLALGHYLLILQQQVNPRRAFGDVTAHLLQPCLVLRHLLSGGTWTQAGQGQLRQVLSRDIRSQIEAMFRGGIFQPELLSSYKEGLLDQQQGDVKTGAMKNLLAPMDTVLNRLVDAGYCAASLHTSVVANSVALLYKLFLDSYFKEGNQLLCFQVLPRLFGCLKISHLQEEQSKALSTSDWTTELLVVEQLLNSVANNNIYNIAADRIRHEEAQFRFYRHVAELLINHAQAPIPAWFRCLKTLISLNHLILEPDLDDLLASAWIDAEVTEFRTKKAQEALIRTVFQTYAKLRQVPRLFEEVLGVICRPAAEALRQPVLASGPSTVLSACLLELPPSQILDTWSLVLEKFQSLVLPYLQSDADMALKLLSLSLLLHCIMFNMRSLDSSTPLPIVRRTQCMMERMMRELVQPLLALLPDTPGPEPELWLQKVSDSVLLLSYTWAQVDAMFSLNCSQYHSMSGPLIGVALEISNLPSLLPGVKTQHWKKIEKFTAQFSSLGTYCLEQLYLQKMKRTLMQTSFRSEGAIQSLRCDAAFIIGSGRKSLNQRTTASWDGQVGMVSGLTYPVAHWHLIVSNLTILISYLCPDDVGYLASVLLRTLPMGKAQEVSIDEEAYITLEKISKAFLHSPLFPEMQSLHSAFLTCVTTSCSSILCSGAQRDSGLVSQQLPWLFEKDHMVVGHWENRFAKAGPEGIEPRGEIAQNLLSLVKSDFPIQLEGEQLESILGLLEVISALQLDSLLPPYHVHYFLVLLSMAVTKLGCSCSSSLALKFLTTCYQLLGYLQKGKSARSVFKIMYGSDIFEVVLTSLFRASSRFLIEMDDPAWLEFLQVIGTFLEELMQMLIQMKLSLVLNFRKITAFLSSSKPYTEAASSKQLENQNPQGRQLLLVSLTRLCHVLGPFLKEQKLGQEAPAALSELLQQVVLQTGAVLQLCSVPGARGWRLPSVLISSVSTLLEADLGQHCRDGGADISQGSDRTLLSHVALYQGVYSQILLELPALAGHDQSFQAALQFLTLFFLAPELHPKKDSVFTSMFHSVRRVLADPEIPVQVTQDIEPHLGALFTQMLEVGTTEDLRLVMQCILQGLDVSNMWKADVQAVVSAVTLLRLLLNCPLSGEKASLLWRACPQIVTALTLLNREASQEQPVSLTVVGPVLDVLAALLRQGEEAIGNPHHVSLAFSILLTVPLDHLKPLEYGSVFPRLHNVLFSILQCHPKVMLKAIPSFLNSFNRLVFSVMREGRQKDKGSIDDLPTVLKCARLVERMYSHIAARAEEFAVFSPFMVAQYVLEVQKVKLGSMSFTKYCVYGP

SEQ ID NO: 739699 - protein, 115 aa, Homo sapiens
MSYKPNLAAHMPAAALNAAGSVHSPSTSMATSSQYRQLLSDYGPPSLGYTQGTGNSQVPQSKYAELLAIIEELGKEIRPTYAGSKSAMERLKRGIIHARGLVRECLAETERNARS

SEQ ID NO: 739700 - protein, 135 aa, Homo sapiens
AWHQLSVPEAKSAAPTVCVRERPCGSGGGRRAAAEGGLAGSVHSPSTSMATSSQYRQLLSDYGPPSLGYTQGTGNSQVPQSKYAELLAIIEELGKEIRPTYAGSKSAMERLKRGIIHARGLVRECLAETERNARS

SEQ ID NO: 739701 - protein, 112 aa, Homo sapiens
MIYVLKYTTSPPFSPAGSVHSPSTSMATSSQYRQLLSDYGPPSLGYTQGTGNSQVPQSKYAELLAIIEELGKEIRPTYAGSKSAMERLKRGIIHARGLVRECLAETERNARS

SEQ ID NO: 739702 - protein, 115 aa, Homo sapiens; identical to SEQ ID NO: 739699

SEQ ID NO: 739703 - protein, 115 aa, Homo sapiens; identical to SEQ ID NO: 739699

SEQ ID NO: 739704 - protein, 115 aa, Homo sapiens; identical to SEQ ID NO: 739699

SEQ ID NO: 739705 - protein, 115 aa, Homo sapiens; identical to SEQ ID NO: 739699

SEQ ID NO: 739706 - protein, 115 aa, Homo sapiens; identical to SEQ ID NO: 739699

SEQ ID NO: 739707 - protein, 115 aa, Homo sapiens; identical to SEQ ID NO: 739699

SEQ ID NO: 739708 - protein, 115 aa, Homo sapiens; identical to SEQ ID NO: 739699

SEQ ID NO: 739709 - protein, 175 aa, Homo sapiens
SPGGGRCGQGQDPRGRARMEGCGAAGAAGLPGALRSRGRRDWDQDGVAGGQRTRRPGGLGRERGSRGYPMRSRGDPREAGSVHSPSTSMATSSQYRQLLSDYGPPSLGYTQGTGNSQVPQSKYAELLAIIEELGKEIRPTYAGSKSAMERLKRGIIHARGLVRECLAETERNARS

SEQ ID NO: 739710 - protein, 153 aa, Homo sapiens
MIYVLKYTTRHHFLQVIFHPCPHHQGEESALRIPVRPGLPQPPRDRPPAHPRGAGRGAAARTRAGLRRRRDPSPPNFGKLRAPSAPGGAGRGRRRSRPLTPGRPLPAPAAPPAPRKVCGRPCAAPGAWVRLRWECPLAFHQHGNVFTVPPAAQ

SEQ ID NO: 739711 - protein, 274 aa, Homo sapiens
AEFQIGCGGRGAAVLRLCSALVVSGSSGQRRLLARQMASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEESGDIVSLIHD

SEQ ID NO: 739712 - protein, 461 aa, Homo sapiens
AEFQIGCGGRGAAVLRLCSALVVSGSSGQRRLLARQMASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEERTLRGSSVPCLPMELGKAPDCYGVPGLSAHGPILGAGPRLWTSPNLGLFPHSTCIMAMMGSKAGPCQLYVLRGHIPTTFPGLILCSSGWEGPLRAHHTQWHQSLPFSLVVTSSLSFMTEEVPAGNAHLPRVFLTVLLLHLMHEQVKEKAHRADGHSRVGSTYLPLEARAANLTDPVINSTLGAPSSYSHLPAPPTPQ

SEQ ID NO: 739713 - protein, 231 aa, Homo sapiens [sequence omitted]

SEQ ID NO: 739714 - protein, 198 aa, Homo sapiens
AEFQIGCGGRGAAVLRLCSALVVSGSSGQRRLLARQMASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQILSLETHRTLDLEPSICLIYNMKC

SEQ ID NO: 739715 - protein, 171 aa, Homo sapiens
MASRWQNMGTSVRRRSLQHQEQLEDSKELQPVVSHQETSVGALGSLCRQFQRRLPLRAVNLNLRAGPSWKRLVFGESSAESLTHCVSGAKALEGPTLIPPFPTRDSEEGIGDISRLTTLGSRVPIYMLSAEHCGCARRGSPVQEQFLPFVNYLRNLLCHFIRKKPACDFPR

SEQ ID NO: 739716 - protein, 274 aa, Homo sapiens; identical to SEQ ID NO: 739711

SEQ ID NO: 739717 - protein, 284 aa, Homo sapiens
AEFQIGCGGRGAAVLRLCSALVVSGSSGQRRLLARQMASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEERKQALSDRQGFILKDVYASP

SEQ ID NO: 739718 - protein, 274 aa, Homo sapiens; identical to SEQ ID NO: 739711

SEQ ID NO: 739719 - protein, 214 aa, Homo sapiens
AEFQIGCGGRGAAVLRLCSALVVSGSSGQRRLLARQMASRWQNMGTSVRRRSLQHQEQLEDSKELQPVVSHQETSVGALGSLCRQFQRRLPLRAVNLNLRAGPSWKRLETPEPENPGVLPKWHQVAGGDPGEGQEAEERSTEGQWIPNSQPEPEEHPAVWSRPCPLSRRPLGEGASPPLCPDGLTCPPITAIKAGGCLPEPLLLNRAPLLSQRV

SEQ ID NO: 739720 - protein, 105 aa, Homo sapiens
SAQSFLGVCRPQPDRLAQVHPQKVLHSAVPHGAAWDGRESEQRKCPLLGEGERRNIVQEKYRNVEVGKMSIVQPSKIMLNCLKNSPAWAGHCNPSTLGGRGGCIT

SEQ ID NO: 739721 - protein, 153 aa, Homo sapiens
PKAKKEAPVPPKAEAKTKVLKAKKAVFKGVHSHTKKDLHVTHLPAAHDTATPEAAQISSAERPQENKLDHYAIIKFLLTTESAMKKIEDSNTLVFVVDVKANKHQIKQAVKKLYDIDVAKVNTLIRPDGEKKAYVQLAPDYNALDVANKIGII

SEQ ID NO: 739722 - protein, 977 aa, Homo sapiens
MKPSIAEMLHRGRMLWIILLSTIALGWTTPIPLIEDSEEIDEPCFDPCYCEVKESLFHIHCDSKGFTNISQITEFWSRPFKLYLQRNSMRKLYTNSFLHLNNAVSINLGNNALQDIQTGAFNGLKILKRLYLHENKLDVFRNDTFLGLESLEYLQADYNVIKRIESGAFRNLSKLRVLILNDNLIPMLPTNLFKAVSLTHLDLRGNRLKVLFYRGMLDHIGRSLMELQLEENPWNCTCEIVQLKSWLERIPYTALVGDITCETPFHFHGKDLREIRKTELCPLLSDSEVEASLGIPHSSSSKENAWPTKPSSMLSSVHFTASSVEYKSSNKQPKPTKQPRTPRPPSTSQALYPGPNQPPIAPYQTRPPIPIICPTGCTCNLHINDLGLTVNCKERGFNNISELLPRPLNAKKLYLSSNLIQKIYRSDFWNFSSLDLLHLGNNRISYVQDGAFINLPNLKSLFLNGNDIEKLTPGMFRGLQSLHYLYFEFNVIREIQPAAFSLMPNLKLLFLNNNLLRTLPTDAFAGTSLARLNLRKNYFLYLPVAGVLEHLNAIVQIDLNENPWDCTCDLVPFKQWIETISSVSVVGDVLCRSPENLTHRDVRTIELEVLCPEMLHVAPAGESPAQPGDSHLIGAPTSASPYEFSPPGGPVPLSVLILSLLVLFFSAVFVAAGLFAYVLRRRRKKLPFRSKRQEGVDLTGIQMQCHRLFEDGGGGGGGSGGGGRPTLSSPEKAPPVGHVYEYIPHPVTQMCNNPIYKPREEEEVAVSSAQEAGSAERGGPGTQPPGMGEALLGSEQFAETPKENHSNYRTLLEKEKEWALAVSSSQLNTIVTVNHHHPHHPAVGGVSGVVGGTGGDLAGFRHHEKNGGVVLFPPGGGCGSGSMLLDRERPQPAPCTVGFVDCLYGTVPKLKELHVHPPGMQYPDLQQDARLKETLLFSAGKGFTDHQTQKSDYLELRAKLQTKPDYLEVLEKTTYRF

SEQ ID NO: 739723 - protein, 977 aa, Homo sapiens; identical to SEQ ID NO: 739722

SEQ ID NO: 739724 - protein, 69 aa, Homo sapiens
MCHSLPVTFFSTPPPMHLTQKVHEATLSAVSHRHCSIQGLCTGGQQDALGFLQGLSHAWVPVQSRPQGS

SEQ ID NO: 739725 - protein, 82 aa, Homo sapiens
RRRTTTPRDTFTCVTNIHMYTKPKFPPAMGCGLFSGVEQSLDFRSITHHNVSSTWLGDLRKRTIMAEGEAVTFFTSVIFVDA

SEQ ID NO: 739726 - protein, 406 aa, Homo sapiens
PGPAPRGSASRLGARHGDGGSAGLGGRPCIMETLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQEEQRPVQMMYQEATFKLAHVGEVRAQLLELPYARKELSLLVLLPDDGVELSTVEKSLTFEKLTAWTKPDCMKSTEVEVLLPKFKLQEDYDMESVLRHLGIVDAFQQGKADLSAMSAERDLCLSKFVHKSFVEVNEEGTEAAAASSCFVVAECCMESGPRFCADHPFLFFIRHNRANSILFCGRFSSP

SEQ ID NO: 739727 - protein, 376 aa, Homo sapiens
METLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQEEQRPVQMMYQEATFKLAHVGEVRAQLLELPYARKELSLLVLLPDDGVELSTVEKSLTFEKLTAWTKPDCMKSTEVEVLLPKFKLQEDYDMESVLRHLGIVDAFQQGKADLSAMSAERDLCLSKFVHKSFVEVNEEGTEAAAASSCFVVAECCMESGPRFCADHPFLFFIRHNRANSILFCGRFSSP

SEQ ID NO: 739728 - protein, 376 aa, Homo sapiens; identical to SEQ ID NO: 739727

SEQ ID NO: 739729 - protein, 194 aa, Homo sapiens
METLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQVGEAF

SEQ ID NO: 739730 - protein, 340 aa, Homo sapiens
REGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 739731 - protein, 340 aa, Homo sapiens; identical to SEQ ID NO: 739730

SEQ ID NO: 739732 - protein, 340 aa, Homo sapiens; identical to SEQ ID NO: 739730

SEQ ID NO: 739733 - protein, 319 aa, Homo sapiens
REGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 739734 - protein, 340 aa, Homo sapiens; identical to SEQ ID NO: 739730

SEQ ID NO: 739735 - protein, 94 aa, Homo sapiens
KISVEGGYCVSLKWPLCCVSGVLVLSWYPPGMADDNGEPSDDLVPAILDTAHQYSIQVSLQEEATCSLPYSGELLSSAHRVSASTEVLGSSPKG

SEQ ID NO: 739736 - protein, 75 aa, Homo sapiens
SGVLVLSWYPPGMADDNGEPSDDLVPAILDTAHQYSIQVSLQEEATCSLPYSGELLSSAHRVSASTEVLGSSPKG

SEQ ID NO: 739737 - protein, 104 aa, Homo sapiens
MLGTQHHLSHWITGVCYHAWPIFVFLVEMGFCHVAQAGLELLTSSDLPALASQSAGITDVSHPTQLILKNNFKKTFETAQIYIKVVSTVERIFSLNHLRVKLPT

SEQ ID NO: 739738 - protein, 118 aa, Homo sapiens
SRRTVTCMCRGWGPICLGGPRDGSAVTEGAKTPFRVGEGERSHRFNMKNSFRKWEGWGPTAHAVPDGTPCRWVAGGGQGNRLQFSGMPLDLLTQWPNSWLLPSSPTPKTSRSEQLSCG

SEQ ID NO: 739739 - protein, 105 aa, Homo sapiens
MWQAPFSVSQWLGSGSLAVPPAPPCLLLPSSFPGPTRCSSCQLCCRATAALEPLTMSEPPALHVPLIAVSLPTPPWPRDPWTGWGWGVCPLCSSQEPQLRVSGVQ

SEQ ID NO: 739740 - protein, 105 aa, Homo sapiens; identical to SEQ ID NO: 739739

SEQ ID NO: 739741 - protein, 92 aa, Homo sapiens
VLSQALSAYSPHPGHPGRRRRQLLLISVSLKSLLVWAHTVRHCISTTPTVSHLLRVRPRDLQEAAGSIRVTTSLGSKPLARLPQRAEASATT

SEQ ID NO: 739742 - protein, 153 aa, Homo sapiens
SLLRGSLCQGSPKKLSLGLLPTPESFSKHDSYVQVVKGDTSVMSTFLSFLEERPLGKSQVWERSGLLARYCFQRCRCHLGNAHVCSATDWWQGVQEENINLKQREGGDKLTCTRELRSGVYVSERAKLYQCSQARLQTICPVETSMMMKMFYI

SEQ ID NO: 739743 - protein, 127 aa, Homo sapiens
VPIQLPGGNSRASVSFIHPWAQRCGRVQHACSLQVTRRRQSLGADTGDERPEVARLFPRPHSHVSFPRQGFEVGRVFHVLPGEVFWVPLSPFLRFPCPATLGTPGAACRTLQPPPGEAGFYLLSPAL

SEQ ID NO: 739744 - protein, 103 aa, Homo sapiens
MCLHKYAHTKLKKGCHLSTQLPAPSRSPNCSAEKNSLEEHKETQELFLLAFPVTSGITFGKSLHPQDLNLIIYKRTEAAICERSGFSSYVLSNQKVLSAIKLC

SEQ ID NO: 739745 - protein, 790 aa, Homo sapiens
MSSKAEKKQRLSGRGSSQASWSGRATRAAVATQEQGNAPAVSEPELQAELPKEEPEPRLEGPQAQSEESVEPEADVKPLFLSRAALTGLADAVWTQEHDAILEHFAQDPTESILTIFIDPCFGLKLELGMPVQTQNQLVYFIRQAPVPITWENFEATVQFGTVRGPYIPALLRLLGGVFAPQIFANTGWPESIRNHFASHLHKFLACLTDTRYKLEGHTVLYIPAEAMNMKPEMVIKDKELVQRLETSMIHWTRQIKEMLSAQETVETGENLGPLEEIEFWRNRCMDLSGISKQLVKKGVKHVESILHLAKSSYLAPFMKLAQQIQDGSRQAQSNLTFLSILKEPYQELAFMKPKDISSKLPKLISLIRIIWVNSPHYNTRERLTSLFRKVCDCQYHFARWEDGKQGPLPCFFGAQGPQITRNLLEIEDIFHKNLHTLRAVRGGILDVKNTCWHEDYNKFRAGIKDLEVMTQNLITSAFELVRDVPHGVLLLDTFHRLASREAIKRTYDKKAVDLYMLFNSELALVNRERNKKWPDLEPYVAQYSGKARWVHILRRRIDRVMTCLAGAHFLPRIGTGKESVHTYQQMVQAIDELVRKTFQEWTSSLDKDCIRRLDTPLLRISQEKAGMLDVNFDKYRSHLAPFPYTPLLQLSQEFHSHLLTPLFIILSLSHTICLLSSFYFFFSSFIFVSPHLPPCYQHFNFTTYLKTQQNKTMIGQARWLTPVIPALWEAEVGASLEPRSLRTAWATWQNPVSAKNTKISWAWWHKPVVSATWEGEVGGSPEPGRQRLQ

SEQ ID NO: 739746 - protein, 790 aa, Homo sapiens; identical to SEQ ID NO: 739745

SEQ ID NO: 739747 - protein, 401 aa, Homo sapiens
MVCDCQYHFARWEDGKQGPLPCFFGAQGPQITRNLLEIEDIFHKNLHTLRAVRGGILDVKNTCWHEDYNKFRAGIKDLEVMTQNLITSAFELVRDVPHGVLLLDTFHRLASREAIKRTYDKKAVDLYMLFNSELALVNRERNKKWPDLEPYVAQYSGKARWVHILRRRIDRVMTCLAGAHFLPRIGTGKESVHTYQQMVQAIDELVRKTFQEWTSSLDKDCIRRLDTPLLRISQEKAGMLDVNFDKYRSHLAPFPYTPLLQLSQEFHSHLLTPLFIILSLSHTICLLSSFYFFFSSFIFVSPHLPPCYQHFNFTTYLKTQQNKTMIGQARWLTPVIPALWEAEVGASLEPRSLRTAWATWQNPVSAKNTKISWAWWHKPVVSATWEGEVGGSPEPGRQRLQ

SEQ ID NO: 739748 - protein, 74 aa, Homo sapiens
RGQGQASLELRRAGRRDWCPAEREPAVRSRRAGVKEEKLESEGKAEERGPRSAKESDCTVASLTSGGSLRRAAP

SEQ ID NO: 739749 - protein, 963 aa, Homo sapiens
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNGNVPVMPSLDELNPKSTVDLLLFDAGTSSFTESSSATTNSTGNIFDELPVTNGLHAEPPVRRDNPFFRSKRSYSLSELSVLQAKSDAPTSSSFFTGLKSPAPEQFQSREDFRTAWLNHRKLARSCHDLDLLGQSPGWGQTQAVETNIVCKLDSSGGAVQLPDTSISIHVPEGHVAPGETQQISMKALLDPPLELNSDRSCSISPVLEVKLSNLEVKTSIILEMKVSAEIKNDLFSKSTVGLQCLRSDSKEGPYVSVPLNCSCGDTVQAQLHNLEPCMYVAVVAHGPSILYPSTVWDFINKKVTVGLYGPKHIHPSFKTVVTIFGHDCAPKTLLVSEVTRQAPNPAPVALQLWGKHQFVLSRPQDLKVCMFSNMTNYEVKASEQAKVVRGFQLKLGKVSRLIFPITSQNPNELSDFTLRVQVKDDQEAILTQFCVQTPQPPPKSAIKPSGQRRFLKKNEVGKIILSPFATTTKYPTFQDRPVSSLKFGKLLKTVVRQNKNHYLLEYKKGDGIALLSEERVRLRGQLWTKEWYIGYYQGRVGLVHTKNVLVVGRARPSLCSGPELSTSVLLEQILRPCKFLTYIYASVRTLLMENISSWRSFADALGYVNLPLTFFCRAELDSEPERVASVLEKLKEDCNNTENKERKSFQKELVMALLKMDCQGLVVRLIQDFVLLTTAVEVAQRWRELAEKLAKVSKQQMDAYESPHRDRNGVVDSEAMWKPAYDFLLTWSHQIGDSYRDVIQELHLGLDKMKNPITKRWKHLTGTLILVNSLDVLRAAAFSPADQDDFVI

SEQ ID NO: 739750 - protein, 78 aa, Homo sapiens
VPSVALMLAGSALKGAGSVVMSAPCDLRRRPHCCASPFSPGQKAVSWDFSDGERLRLYQRIHFLLPPVERSHSSKKPG

SEQ ID NO: 739751 - protein, 343 aa, Homo sapiens
MGFSSKGSNEVGKIILSPFATTTKYPTFQDRPVSSLKFGKLLKTVVRQNKNHYLLEYKKGDGIALLSEERVRLRGQLWTKEWYIGYYQGRVGLVHTKNVLVVGRARPSLCSGPELSTSVLLEQILRPCKFLTYIYASVRTLLMENISSWRSFADALGYVNLPLTFFCRAELDSEPERVASVLEKLKEDCNNTENKERKSFQKELVMALLKMDCQGLVVRLIQDFVLLTTAVEVAQRWRELAEKLAKVSKQQMDAYESPHRDRNGVVDSEAMWKPAYDFLLTWSHQIGDSYRDVIQELHLGLDKMKNPITKRWKHLTGTLILVNSLDVLRAAAFSPADQDDFVI

SEQ ID NO: 739752 - protein, 123 aa, Homo sapiens
PFSGGRGCGPVQPPLPTPPGRCGLTPTSTGRPSPSWPSGDLSCPAGPNSTAQRRLRVPRPGPLAPSRPRMSGKLCSGSPRGGAGRSRRTEGARFENAEDGVCDRLPAPSSPPHLRRLQVLQGA

SEQ ID NO: 739753 - protein, 287 aa, Homo sapiens
PTKPQAGAGAAAARAYGAEPLARAVGESVRPSVRPSGRRSSRQAQRPRRLVSPHPEPPGGAGLAAAAMSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 739754 - protein, 287 aa, Homo sapiens; identical to SEQ ID NO: 739753

SEQ ID NO: 739755 - protein, 262 aa, Homo sapiens
PTKPQAGAGAAAARAYGAEPLARAVGESVRPSVRPSGRRSSRQAQRPRRLVSPHPEPPGGAGLAAAAMSMGLEITGTALAVLGWLGTIVCCALPMWRVSAFIGSNIITSQNIWEGLWMNCVVQSTGQMQCKVYDSLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 739756 - protein, 246 aa, Homo sapiens
PTKPQAGAGAAAARAYGAEPLARAVGESVRPSVRPSGRRSSRQAQRPRRLVSPHPEPPGGAGLAAAAMSMGLEITGTALAVLGWLGTIVCCALPMWRVSAFIGSNIITSRACTWAGRPRRCSCWGARCSAARVPHARRSTRPPRSSTPRRAPPAREPAWAQATTARTTSKGQTQGDPTTTTTTNTTTTTASWSAHQAIQRAALPRRPAHPQKPGSPRAGLGQLPQQPRLCGPGSRLRGPGTNLHGL

SEQ ID NO: 739757 - protein, 189 aa, Homo sapiens
TIRLGSEAWFEQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 739758 - protein, 145 aa, Homo sapiens
ILPKAQEESVPLPLPDSGGCPRCLFQGAQQAASSPPRLHFHLAPLSNLLPRSVTYVVLVLALGPQDPRSRMFPPQNPEFNRVCQFFFLPCKVVDLQALGVGTWAPEILIVSFVRCIAPHQHLQKPGSPTVSLQSPESHPIRHGGL

SEQ ID NO: 739759 - protein, 110 aa, Homo sapiens
LQLRKQSQLTVPWLSRGACGGKPPPSEGSVDSPGFSVLAGVPLLPNTCPEAACLHNQLPSERFRHALHSGQGLFLDREAEKYQIKMTCMYWKIICGLYVGGWKQTRVIYI

SEQ ID NO: 739760 - protein, 201 aa, Homo sapiens
PKFRNQLIAKGKKDSPKDKKTLLTMNWFGSNFFRCPEDLSLLNIYSPLLSHMSSEDEHFISNLRGHVPASAVVKQPVRGASGRTTITAIVQTGGGWSTGLFSVCRDRRICFCGLFCPMCLECDIARHYGECLCWPLLPGSTFALRIGTRERHKIQGTLCEDWLAVHCCWAFSICQVARELKMRTSQVYEICAVPMTKDTLV

SEQ ID NO: 739761 - protein, 241 aa, Homo sapiens
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLQISNWFINARRRILPDMLQQRRNDPIIGHKTGKDAHATHLQSTEASVPAKSGPSGPDNVQSLPLWPLPKGQMSREKQPDPESAPSQKLTGIAQPKKKVKVSITSPSSPELVSPEEHADFSSFLLLVDAAVQRAAELELEKKQEPNP

SEQ ID NO: 739762 - protein, 103 aa, Homo sapiens
MYSLDPTLQGAEHFNFSKAGTHPRPLGSAPLGLGCGSITLLMTTAFCPLSTSDSWAPSAPPNDSPVTPQELLALSGLSSVPCSSVNKLPAWRPLCHRMWQVYD

SEQ ID NO: 739763 - protein, 108 aa, Homo sapiens
RSLLPSGSKLTEGVSSCWFLTAEGNEWLLQGQIAAGDIENISSQPTISLQIPDDCLSLEAIVSVSVFLYYCSADSSACMMKAILFSQPLQITDTQQGCIAPVELRYVF

SEQ ID NO: 739764 - protein, 108 aa, Homo sapiens; identical to SEQ ID NO: 739763

SEQ ID NO: 739765 - protein, 430 aa, Homo sapiens
GRASWAGPASGCSFTFSSGHLQLLLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEGGAGAGPEPWAGGAPGRSSRCCPGVPGVVLRNAGAGTRYPCCLPAGGTDHAE

SEQ ID NO: 739766 - protein, 280 aa, Homo sapiens
MQAGTGLGCRDLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFRKEAPPGATPKPP

SEQ ID NO: 739767 - protein, 117 aa, Homo sapiens
GRASWAGPASGCSFTFSSGHLQLLLAGRLPGRADAPDAPPSGRRRSRSMGSAFERVVRRVVQELDHGGEFIPVTSLQSSTGFQPYCLVVRKPSSSWFWKPRYKCVNLSLSGLSQEPH

SEQ ID NO: 739768 - protein, 65 aa, Homo sapiens
GTRAAGAKEAPLGLAGVADPVVGRCELVGSLLEQSAPWQERSTMSLCPGMAWQLSSRAECLPTSC

SEQ ID NO: 739769 - protein, 430 aa, Homo sapiens; identical to SEQ ID NO: 739765

SEQ ID NO: 739770 - protein, 494 aa, Homo sapiens
MQAGTGLGCRDSPDGSQGEQTRQTRHPRGADGHGSRAGAVPAPSCLLAQPPLSADPALRGFLGQLQPLHSGPGAPYPSGGPLWPLTPKASALDRWLMELQAQRRPWRTQLGSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEGGAGAGPEPWAGGAPGRSSRCCPGVPGVVLRNAGAGTRYPCCLPAGGTDHAE

SEQ ID NO: 739771 - protein, 265 aa, Homo sapiens
MNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEGGAGAGPEPWAGGAPGRSSRCCPGVPGVVLRNAGAGTRYPCCLPAGGTDHAE

SEQ ID NO: 739772 - protein, 430 aa, Homo sapiens; identical to SEQ ID NO: 739765

SEQ ID NO: 739773 - protein, 429 aa, Homo sapiens
GRASWAGPASGCSFTFSSGHLQLLLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEGGVLPCLGRWAASWSRVPRGRSAAPCPCPPGSWGTAGAKEHRPGSCWTSVA

SEQ ID NO: 739774 - protein, 210 aa, Homo sapiens
MGSLRRGRSLKTSRAYGQRWRPSPRNWSFWTESCASCCWRAWRGCCGTSWPCEPWREALEQGQSLGPVEPLDGPAGAVLECLVLSSGMLVPELAIPVVYLLGALTMLSETQHKLLAEALESQTLLGPLELVGSLLEQSAPWQERSTMSLPPGLLGNSWGEGAPAWVLLDECGLELGEDTPHVCWEPQAQGRMCALYASLALLSGLSQEPH

SEQ ID NO: 739775 - protein, 376 aa, Homo sapiens
GRASWAGPASGCSFTFSSGHLQLLLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLPVQMSMLA

SEQ ID NO: 739776 - protein, 293 aa, Homo sapiens
GRASWAGPASGCSFTFSSGHLQLLLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFRKEAPPGATPKPP

SEQ ID NO: 739777 - protein, 211 aa, Homo sapiens
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDQLALRALEGGAGAGPEPWAGGSPWTVQQVLSWSALVLSPECWCRNSLSLLSTCWGH

SEQ ID NO: 739778 - protein, 122 aa, Homo sapiens
GRASWAGPASGCSFTFSSGHLQLLLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPGA

SEQ ID NO: 739779 - protein, 332 aa, Homo sapiens
GRASWAGPASGCSFTFSSGHLQLLLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERWARRGQGRAGPHPPQATLLLFIYLFKLFFEVRFCYLGQGGLELLASSSPPASASQSAGITGVSHCARSQPCSWEGHNLGASGKSQRQKSAVAGTSLQEGSCRGHLGPPLPGLDPKDRTEPQAAVRTRGGVNTGAQVRGPHLESGLGV

SEQ ID NO: 739780 - protein, 114 aa, Homo sapiens
PSEQLPALRLAAERSHLAAGCPGTRPAPAPHGPVPGPSPRPISMPQGEGQGHLSQKKTVTIPSGSTLAFRVAQLVIDSDLGELELGVSRAQALAEKQGGLGRATRQLGLPWAPG

SEQ ID NO: 739781 - protein, 430 aa, Homo sapiens; identical to SEQ ID NO: 739765

SEQ ID NO: 739782 - protein, 470 aa, Homo sapiens
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLGELELGVSRAQALAEKQGGLGRATRQLGLPWAPGWTTSCVWQVAEVLCSGVWVIGQGLSWTGELLVGEGRGCWDLGDMPVLSAPVWLPDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEGGAGAGPEPWAGGAPGRSSRCCPGVPGVVLRNAGAGTRYPCCLPAGGTDHAE

SEQ ID NO: 739783 - protein, 265 aa, Homo sapiens; identical to SEQ ID NO: 739771

SEQ ID NO: 739784 - protein, 470 aa, Homo sapiens; identical to SEQ ID NO: 739782

SEQ ID NO: 739785 - protein, 378 aa, Homo sapiens
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEGGAGAGPEPWAGGSPWTVQQVLSWSALVLSPECWCRNSLSLLSTCWGH

SEQ ID NO: 739786 - protein, 135 aa, Homo sapiens
GRWGQVAGGREGGGLSRWAFRNPLLPDSLPVLSETQHKLLAEALESQTLLGPLELVGSLLEQSAPWQERSTMSLPPGLLGNSWGEGAPAWVLLDECGLELGEDTPHVCWEPQAQGRMCALYASLALLSGLSQEPH

SEQ ID NO: 739787 - protein, 213 aa, Homo sapiens
GRASWAGPASGCSFTFSSGHLQLLLAGRLPGRADAPDAPPSGRRRSRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQRVFAHQLLALGRPGAQ

SEQ ID NO: 739788 - protein, 154 aa, Homo sapiens
SACPDRGFPGPCKHLGSASPSVPTDGVPAEGAFTEDFQGLRAEVETISKELELLDRELCQLLLEGLEGVLRDQLALRALEGGGAGEGARGTQGLPSQPDSPALPVPTAGAGPEPWAGGAPGRSSRCCPGVPGVVLRNAGAGTRYPCCLPAGGTD

SEQ ID NO: 739789 - protein, 431 aa, Homo sapiens
SLGRWWSDLAPVLRPYQPSRSQLLLLPVCLEMATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGSLAMEELKSGSGPSLKGEEEPLVASEDGAVDAPAPDEPEGGDGAAP

SEQ ID NO: 739790 - protein, 431 aa, Homo sapiens; identical to SEQ ID NO: 739789

SEQ ID NO: 739791 - protein, 400 aa, Homo sapiens
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGSLAMEELKSGSGPSLKGEEEPLVASEDGAVDAPAPDEPEGGDGAAP

SEQ ID NO: 739792 - protein, 431 aa, Homo sapiens; identical to SEQ ID NO: 739789

SEQ ID NO: 739793 - protein, 537 aa, Homo sapiens
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGLCVATVGIAVLIRILTTFLMVCFAGFNLKEKIFISFAWLPKATVQAAIGSVALDTARSHGEKQLEDYGMDVLTVAFLSILITAPIGSLLIGLLGPRLLQKVEHQNKDEEVQGETSVQV

SEQ ID NO: 739794 - protein, 474 aa, Homo sapiens
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGCNRICGFGHSKVTWRETIRRLWNGCVDSGIFVHPHHSPNWKSAYWFTGPQASAES

SEQ ID NO: 739795 - protein, 537 aa, Homo sapiens; identical to SEQ ID NO: 739793

SEQ ID NO: 739796 - protein, 465 aa, Homo sapiens
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGLCVATVGIAVLIRILTTFLMVCFAGFNLKEKIFISFAWLPKATVQV

SEQ ID NO: 739797 - protein, 110 aa, Homo sapiens
MRLHSSLGKSETLSQYFFKKKILEECTDHVSRPYGWGLCKDFGFYSEKLLHIGELFRGFLPGCLYPFWLTMTCKLLYVSSPYCFLGFLSFLFKVLAQDFLRLEPHKARRN

SEQ ID NO: 739798 - protein, 71 aa, Homo sapiens
RASTMSFNTLYLLQFQKQSCLLQQTGKCDAFVKFPVAKDTLHMPLDQEIALMGTLQMDFYTSEVMHWPHYS

SEQ ID NO: 739799 - protein, 276 aa, Homo sapiens
MFLVTISCYTRGGRIISTSSRSVMVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 739800 - protein, 255 aa, Homo sapiens
MFLVTISCYTRGGRIISTSSRSVMLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 739801 - protein, 168 aa, Homo sapiens
GNESPERVRQQSSGLVARREEGLQARAIGNWKGSRHGSGVEGRERPFYPLPRLLSKALPCSPPFPHTHSAAGLAIKCGCLTHRLDHETLVAEGGLGEALGGRTETSKGFTAAHALWHNPLIYGAAFPSPDLEFPFSRTFFFLSSLGPPGPSTQQSLTVSCICPAKWSE

SEQ ID NO: 739802 - protein, 1127 aa, Homo sapiens
MKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 739803 - protein, 1379 aa, Homo sapiens
LQDPLFSERQHCNRLNIEELLKHMYEVCQEMGLMEDLLKLPFTDTEQECLREIFASPSASVQNHEFLLVHHLQRANYVPALKLNQTLKINVMNDRDPRLRERSLARNSILDQYGKILPRVHRKLAIERAKPYHLSTSSVFRLVSRPKPLSAVPKQVVTGTVLTRSVFINNVLSKIGEVWASKEPINSTTPFNSSKIEEPSPIVYSLPAPELPEAFFGTPISKASQKISRLLDLVVQPVPRPSQCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 739804 - protein, 1331 aa, Homo sapiens
MFSEIFASPSASVQNHEFLLVHHLQRANYVPALKLNQTLKINVMNDRDPRLRERSLARNSILDQYGKILPRVHRKLAIERAKPYHLSTSSVFRLVSRPKPLSAVPKQVVTGTVLTRSVFINNVLSKIGEVWASKEPINSTTPFNSSKIEEPSPIVYSLPAPELPEAFFGTPISKASQKISRLLDLVVQPVPRPSQCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 739805 - protein, 1148 aa, Homo sapiens
HGINPECPLRPGCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 739806 - protein, 1127 aa, Homo sapiens; identical to SEQ ID NO: 739802

SEQ ID NO: 739807 - protein, 993 aa, Homo sapiens
MKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKER

SEQ ID NO: 739808 - protein, 1127 aa, Homo sapiens; identical to SEQ ID NO: 739802

SEQ ID NO: 739809 - protein, 992 aa, Homo sapiens
MKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKG

SEQ ID NO: 739810 - protein, 112 aa, Homo sapiens
LLPQLQNFRPAQPFWLPDLGLRLTVFCGVLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739811 - protein, 105 aa, Homo sapiens
ASRAGFESAEDLGLRLTVFCGVLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739812 - protein, 107 aa, Homo sapiens
GWYWSGVYGWLPDLGLRLTVFCGVLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739813 - protein, 110 aa, Homo sapiens
AGTVRSVGIAAIWLPDLGLRLTVFCGVLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739814 - protein, 112 aa, Homo sapiens; identical to SEQ ID NO: 739810

SEQ ID NO: 739815 - protein, 112 aa, Homo sapiens; identical to SEQ ID NO: 739810

SEQ ID NO: 739816 - protein, 112 aa, Homo sapiens; identical to SEQ ID NO: 739810

SEQ ID NO: 739817 - protein, 111 aa, Homo sapiens
LPPRTSIRLGRARGKSAEGLRLTVFCGVLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739818 - protein, 107 aa, Homo sapiens; identical to SEQ ID NO: 739812

SEQ ID NO: 739819 - protein, 112 aa, Homo sapiens; identical to SEQ ID NO: 739810

SEQ ID NO: 739820 - protein, 112 aa, Homo sapiens; identical to SEQ ID NO: 739810

SEQ ID NO: 739821 - protein, 112 aa, Homo sapiens; identical to SEQ ID NO: 739810

SEQ ID NO: 739822 - protein, 101 aa, Homo sapiens
TRGSTHASGLRLTVFCGVLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739823 - protein, 103 aa, Homo sapiens
MVPVGKGMILGLRLTVFCGVLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739824 - protein, 102 aa, Homo sapiens
MPRAPQRSGEQQCRFGHVWRARTTGTVPGRQSGLSALGLSPQPQDLGSGPVRPSLSCRLLAAPPPADFFSRSEPIFSLVHWGMPDAVSDETWNWPLGLPPAS

SEQ ID NO: 739825 - protein, 95 aa, Homo sapiens
LLPQLQNFRPAQPFWLPDLGLRLTVFCGVLRAIMSVLTPLLLRGLTGSARRLPVPRAKILLLRDLPPCQRAGSCHTWRPTGGQSEGVRSVPHTVT

SEQ ID NO: 739826 - protein, 103 aa, Homo sapiens
HASAFWLPDLGLRLTVFCGVLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739827 - protein, 104 aa, Homo sapiens
MSPDLAPRRVLGVVVVTMSACLRAIMSVLTPLLLRGLTGSARRLPVPRAKIHSLPPEGKLGIMELAVGLTSCFVTFLLASGLDPVTPGDLQEARVKGSVLSLTL

SEQ ID NO: 739828 - protein, 112 aa, Homo sapiens; identical to SEQ ID NO: 739810

SEQ ID NO: 739829 - protein, 112 aa, Homo sapiens; identical to SEQ ID NO: 739810

SEQ ID NO: 739830 - protein, 103 aa, Homo sapiens; identical to SEQ ID NO: 739826

SEQ ID NO: 739831 - protein, 112 aa, Homo sapiens; identical to SEQ ID NO: 739810

SEQ ID NO: 739832 - protein, 70 aa, Homo sapiens
TCCITRLGERTQLPELTEEKYQHRNLTGKMLHESHRTATLAPSLSSAPQPSDLNSGSTTSSPGLQPHVPP

SEQ ID NO: 739833 - protein, 68 aa, Homo sapiens
PAASPGWVNGHNCQNSQNRSISTETSQEKCSTSLTEQPHWLLHCLQLHNLRHQWEHRLLPGPPAQRIS

SEQ ID NO: 739834 - protein, 136 aa, Homo sapiens
MAGVCLSVLAARVSALLHHWPFVSVPSTGLLKHRDPPGTFLPLGFHSCYSLLPFSTWRPPFLLLLCCPHLHLGPPSSREMAEPHSPPASHPLQRSSQSCPQHGSLHSPWVSPPVSCLPRTPDLPLPGWPRWILYSD

SEQ ID NO: 739835 - protein, 255 aa, Homo sapiens [sequence omitted]

SEQ ID NO: 739836 - protein, 115 aa, Homo sapiens
EGGREGAFGVLSLASTQLSLPSAPRLPLPAPSHGTQDPKEHLRLWVPGVQVFGPGSSRETSPPHDWQLPGSLAHLQIPAPPTVLTTQPATPLGQPCLSQTSCLSPCPPGRPLKPL

SEQ ID NO: 739837 - protein, 287 aa, Homo sapiens
PREPLLAGSQARPPAAGAATMEESGMAHESAEDLFHFNVGGWHFSVPRSKLSQFPDSLLWKEASALTSSESQRLFIDRDGSTFRHVHYYLYTSKLSFSSCAELNLLYEQALGLQLMPLLQTLDNLKEGKHHLRVRPADLPVAERASLNYWRTWKCISKPSEFPIKSPAFTGLHDKAPLGLMDTPLLDTEEEVHYCFLPLDLVAKYPSLVTEDNLLWLAETVALIECECSEFRFIVNFLRSQKILLPDNFSNIDVLEAEVEILEIPALTEAVRWYRMNMGMSPGNLGS

SEQ ID NO: 739838 - protein, 107 aa, Homo sapiens [sequence omitted]

SEQ ID NO: 739839 - protein, 262 aa, Homo sapiens
MAHESAEDLFHFNVGGWHFSVPRSKLSQFPDSLLWKEASALTSSESQRLFIDRDGSTFRHVHYYLYTSKLSFSSCAELNLLYEQALGLQLMPLLQTLDNLKEGKHHLRVRPADLPVAERASLNYWRTWKCISKPSEFPIKSPAFTGLHDKAPLGLMDTPLLDTEEEVHYCFLPLDLVAKYPSLVTEDNLLWLAETVALIECECSEFRFIVNFLRSQKILLPDNFSNIDVLEAEVEILEIPALTEAVRWYRMNMGMSPGNLGS

SEQ ID NO: 739840 - protein, 1150 aa, Homo sapiens
GSRAAAASRAAAAMSDIVEKTLTALPGLFLQNQPGGGPAAAKASFSSRLGSLVRGITALTSKHEEEKLIQQELSSLKATVSAPTTTLKMMKECMVRLIYCEMLGYDASFGYIHAIKLAQQGNLLEKRVGYLAVSLFLHESHELLLLLVNTVVKDLQSTNLVEVCMALTVVSQIFPREMIPAVLPLIEDKLQHSKEIVRRKAVLALYKFHLIAPNQVQHIHIKFRKALCDRDVGVMAASLHIYLRMIKENSSGYKDLTGSFVTILKQVVGGKLPVEFNYHSVPAPWLQIQLLRILGLLGKDDQRTSELMYDVLDESLRRAELNHNVTYAILFECVHTVYSIYPKSELLEKAAKCIGKFVLSPKINLKYLGLKALTYVIQQDPTLALQHQMTIIECLDHPDPIIKRETLELLYRITNAQNITVIVQKMLEYLHQSKEEYVIVNLVGKIAELAEKYAPDNAWFIQTMNAVFSVGGDVMHPDIPNNFLRLLAEGFDDETEDQQLRLYAVQSYLTLLDMENVFYPQRFLQVMSWVLGEYSYLLDKETPEEVIAKLYKLLMNDSVSSETKAWLIAAVTKLTSQAHSSNTVERLIHEFTISLDTCMRQHAFELKHLHENVELMKSLLPVDRSCEDLVVDASLSFLDGFVAEGLSQGAAPYKPPHQRQEEKLSQEKVLNFEPYGLSFSSSGFTGRQSPAGISLGSDVSGNSAETGLKETNSLKLEGIKKLWGKEGYLPKKESKTGDESGALPVPQESIMENVDQAITKKDQSQVLTQSKEEKEKQLLASSLFVGLGSESTINLLGKADTVSHKFRRKSKVKEAKSGETTSTHNMTCSSFSSLSNVAYEDDYYSNTLHDTGDKELKKFSLTSELLDSESLTELPLVEKFSYCSLSTPSLFANNNMEIFHPPQSTAASVAKESSLASSFLEETTEYIHSNAMEVCNNETISVSSYKIWKDDCLLMVWSVTNKSGLELKSADLEIFPAENFKVTEQPGCCLPVMEAESTKSFQYSVQIEKPFTEGNLTGFISYHMMDTHSAQLEFSVNLSLLDFIRPLKISSDDFGKLWLSFANDVKQNVKMSESQAALPSALKTLQQKLRLHIIEIIGNEGLLACQLLPSIPCLLHCRVHADVLALWFRSSCSTLPDYLLYQCQKVMEGS

SEQ ID NO: 739841 - protein, 252 aa, Homo sapiens
GSRAAAASRAAAAMSDIVEKTLTALPGLFLQNQPGGGPAAAKASFSSRLGSLVRGITALTSKHEEEKLIQQELSSLKATVSAPTTTLKMMKECMVRLIYCEMLGYDASFGYIHAIKLAQQGNLLEKRVGYLAVSLFLHESHELLLLLVNTVVKDLQSTNLVEVCMALTVVSQIFPREMIPAVLPLIEDKLQHSKEIVRRKAVLALYKFHLIAPNQVQHIHIKFRKALCDRDVGVMAASLHIYLRMIKVSWKF

SEQ ID NO: 739842 - protein, 120 aa, Homo sapiens
MSDIVEKTLTALPGLFLQNQPGGGPAAAKASFSSRLGSLVRGITALTSKHEEEKLIQQELSSLKATVSAPTTTLKMMKECMVRLIYCEMLGYDASFGYIHAIKLAQQGNLLEKRVGMYVF

SEQ ID NO: 739843 - protein, 447 aa, Homo sapiens
GTRGSCRRPRGLPGGPTAMSRDPGSGGWEEAPRAAAALCTLYHEAGQRLRRLQDQLAARDALIARLRARLAALEGDAAPSLVDALLEQVARFREQLRRQEGGAAEAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 739844 - protein, 82 aa, Homo sapiens
VLSISIPLKLIHKSVKEMQELAAGGPFSKTAKLHRVHLRSCCLRTGVIVLPQDSLAGLVSALYRTGRGSFHLRGNSHSANHC

SEQ ID NO: 739845 - protein, 447 aa, Homo sapiens; identical to SEQ ID NO: 739843

SEQ ID NO: 739846 - protein, 469 aa, Homo sapiens
GTRGSCRRPRGLPGGPTAMSRDPGSGGWEEAPRAAAALCTLYHEAGQRLRRLQDQLAARDALIARLRARLAALEGDAAPSLVDALLEQVARFREQLRRQEGGAAEAQMRQVRGRVPEELRERELRVAAAGSWEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 739847 - protein, 442 aa, Homo sapiens
GTRGSCRRPRGLPGGPTAMSRDPGSGGWEEAPRAAAALCTLYHEAGQRLRRLQDQLAARDALIARLRARLAALEGDAAPSLVDALLEQVARFREQLRRQEGGAAEAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHVCTEKLHFSSICHPAGS

SEQ ID NO: 739848 - protein, 173 aa, Homo sapiens [sequence omitted]

SEQ ID NO: 739849 - protein, 281 aa, Homo sapiens
MITTRCTGGRSDNLWPQPLGLAFSPLAVCDRVSSLCPFLMQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 739850 - protein, 171 aa, Homo sapiens
LEDPRYFPSLLEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 739851 - protein, 390 aa, Homo sapiens
GTRGSCRRPRGLPGGPTAMSRDPGSGGWEEAPRAAAALCTLYHEAGQRLRRLQDQLAARDALIARLRARLAALEGDAAPSLVDALLEQVARFREQLRRQEGGAAEAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQVASLLHQVSWRQDSREPDAGRIHAGSFAPS

SEQ ID NO: 739852 - protein, 412 aa, Homo sapiens
GTRGSCRRPRGLPGGPTAMSRDPGSGGWEEAPRAAAALCTLYHEAGQRLRRLQDQLAARDALIARLRARLAALEGDAAPSLVDALLEQVARFREQLRRQEGGAAEAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAAADRERAQSRIQELEEKVASLLHQVSWRQDSREPDAGRIHAGSKTAKYLAADALELMVPGGWRPGTGSQQPEPPAEGGHPGAAQRGQGDLQCPHVCTEKLHFSSICHPAGS

SEQ ID NO: 739853 - protein, 269 aa, Homo sapiens
GTRGSCRRPRGLPGGPTAMSRDPGSGGWEEAPRAAAALCTLYHEAGQRLRRLQDQLAARDALIARLRARLAALEGDAAPSLVDALLEQVARFREQLRRQEGGAAEAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRNIWQREVPVCVPSCSME

SEQ ID NO: 739854 - protein, 97 aa, Homo sapiens
EDLNAKWQRYNASRDEYVRGLHAQLRGLQIPHEPELMRKEISRLNRQLEEKINDCAEVKQELAASRTARDAALERVQMLEQQVSVPRAPDGTDQMSA

SEQ ID NO: 739855 - protein, 113 aa, Homo sapiens
MIIKEYRIPLPMTVEEYRIAQLYMIQVGRGGKGGSWGEGGSRQRTDTTCGLGGVVAFTVQCLPQNFLVSVNCAGPLASRHDARRTEHTMGARHQIAFRHCVPPPTTRTLALAF

SEQ ID NO: 739856 - protein, 1349 aa, Homo sapiens
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSRKMAQFNEDGEEATELVKHEAVSDQTSGEPPEPSSSNGEPLVGRGLKKQWSTSSKSSRSSKRGASPSRHSISEWRMQSIARDSDESSDDEFFDAHEDLSDTEEMFPKDITKWSSNDLMDKIESPEPEDTQDGLYRQGAPEFRVASSVEQLNIIEDEVSQPLAAPPSKIHVLLLVLHGGTILDTGAGDPSSKKGDANTIANVFDTVMRVHYPSALGRLAIRLVPCPPVCSDAFALVSNLSPYSHDEGCLSSSQDHIPLAALPLLATSSPQYQEAVATVIQRANLAYGDFIKSQEGMTFNGQVCLIGDCVGGILAFDALCYSNQPVSESQSSSRRGSVVSMQDNDLLSPGILMNAAHCCGGGGGGGGGGGSSGGGGSSGGSSLESSRHLSRSNVDIPRSNGTEDPKRQLPRKRSDSSTYELDTIQQHQAFLSSLHASVLRTEPCSRHSSSSTMLDGTGALGRFDFEITDLFLFGCPLGLVLALRKTVIPALDVFQLRPACQQVYNLFHPADPSASRLEPLLERRFHALPPFSVPRYQRYPLGDGCSTLLADVLQTHNAAFQEHGAPSSPGTAPASRGFRRASEISIASQVSGMAESYTASSIAQKAPDALSHTPSVRRLSLLALPAPSPTTPGPHPPARKASPGLERAPGLPELDIGEVAAKWWGQKRIDYALYCPDALTAFPTVALPHLFHASYWESTDVVSFLLRQVMRHDNSSILELDGKEVSVFTPSKPREKWQRKRTHVKLRNVTANHRINDALANEDGPQVLTGRFMYGPLDMVTLTGEKVDVHIMTQPPSGEWLYLDTLVTNNSGRVSYTIPESHRLGVGVYPIKMVVRGDHTFADSYITVLPKGTEFVVFSIDGSFAASVSIMGSDPKVRAGAVDVVRHWQDLGYLIIYVTGRPDMQKQRVVAWLAQHNFPHGVVSFCDGLVHDPLRHKANFLKLLISELHLRVHAAYGSTKDVAVYSAISLSPMQIYIVGRPTKKLQQQCQFITDGYAAHLAQLKYSHRARPARNTATRMALRKGSFGLPGQGDFLRSRNHLLRTISAQPSGPSHRHERTQSQADGEQRGQRSMSVAAGCWGRAMTGRLEPGAAAGPK

SEQ ID NO: 739857 - protein, 1349 aa, Homo sapiens; identical to SEQ ID NO: 739856

SEQ ID NO: 739858 - protein, 171 aa, Homo sapiens
MCGPVRMCGPVRMCGPVRMWAWEIVPGPCGGHGPHHTVLPALPHVLGPDGSGLSWKLAGTTSPRMAEGPEPPTQTGPGGSPRHFALCGSPSVLVPGVGPGAACHLPIHWPPSLPGPLPFGSSSNRGPACILLTRVSQLFNLTGFALIFESGDPLPPPMATAPLTCMKLSTC

SEQ ID NO: 739859 - protein, 1349 aa, Homo sapiens; identical to SEQ ID NO: 739856

SEQ ID NO: 739860 - protein, 1343 aa, Homo sapiens
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSRKMAQFNEDGEEATELVKHEAVSDQTSGEPPEPSSSNGEPLVGRGLKKQWSTSSKSSRSSKRGASPSRHSISEWRMQSIARDSDESSDDEFFDAHEDLSDTEEMFPKDITKWSSNDLMDKIESPEPEDTQDGLYRQGAPEFRVASSVEQLNIIEDEVSQPLAAPPSKIHVLLLVLHGGTILDTGAGDPSSKKGDANTIANVFDTVMRVHYPSALGRLAIRLVPCPPVCSDAFALVSNLSPYSHDEGCLSSSQDHIPLAALPLLATSSPQYQEAVATVIQRANLAYGDFIKSQEGMTFNGQVCLIGDCVGGILAFDALCYSNQPVSESQSSSRRGSVVSMQDNDLLSPGILMNAAHCCGGGGGGGGGGGSSGGGGSSGGSSLESSRHLSRSNVDIPRSNGTEDPKRQLPRKRSDSSTYELDTIQQHQAFLSSLHASVLRTEPCSRHSSSSTMLDGTGALGRFDFEITDLFLFGCPLGLVLALRKTVIPALDVFQLRPACQQVYNLFHPADPSASRLEPLLERRFHALPPFSVPRYQRYPLGDGCSTLLVETVQRNPELVLEGGPLAPLPHGDGFLETSMPVPAPTWQDGPRPGCAESDVLQTHNAAFQEHGAPSSPGTAPASRGFRRASEISIASQVSGMAESYTASSIAQIAAKWWGQKRIDYALYCPDALTAFPTVALPHLFHASYWESTDVVSFLLRQVMRHDNSSILELDGKEVSVFTPSKPREKWQRKRTHVKLRNVTANHRINDALANEDGPQVLTGRFMYGPLDMVTLTGEKVDVHIMTQPPSGEWLYLDTLVTNNSGRVSYTIPESHRLGVGVYPIKMVVRGDHTFADSYITVLPKGTEFVVFSIDGSFAASVSIMGSDPKVRAGAVDVVRHWQDLGYLIIYVTGRPDMQKQRVVAWLAQHNFPHGVVSFCDGLVHDPLRHKANFLKLLISELHLRVHAAYGSTKDVAVYSAISLSPMQIYIVGRPTKKLQQQCQFITDGYAAHLAQLKYSHRARPARNTATRMALRKGSFGLPGQGDFLRSRNHLLRTISAQPSGPSHRHERTQSQADGEQRGQRSMSVAAGCWGRAMTGRLEPGAAAGPK

SEQ ID NO: 739861 - protein, 440 aa, Homo sapiens
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSRKMAQFNEDGEEATELVKHEAVSDQTSGEPPEPSSSNGEPLVGRGLKKQWSTSSKSSRSSKRGASPSRHSISEWRMQSIARDSDESSDDEFFDAHEDLSDTEEMFPKDITKWSSNDLMDKIESPEPEDTQDGLYRQGAPEFRVASSVEQLNIIEIKNKIFTLCPACLLSLKIKRRKGRKRQSSRQK

SEQ ID NO: 739862 - protein, 137 aa, Homo sapiens
KLRDPIPGPSQPVVFKEVLRNHQATSILPRGCSPACTTSILPQGCSPGTYHLNLTTGMFICTYHFNLTTGMFTWHVPLQCYHGDVHLACTTSIFPQGCSPAMYYFNLTTGMMFTWHVPLQSYREDVHLARTTLASTL

SEQ ID NO: 739863 - protein, 285 aa, Homo sapiens
MGPGATRWTQGPHSTTVPCDAALMTSRHQSWTPPDQVQFEKCGKRVDRLDQRRSKLRVAGGHPGNSPWTVSLRNRQGQHFCAGSLVKEQWILTARQCFSSCHMPLTGYEVWLGTLFQNPQHGEPGLQRVPVAKMLCGPSGSQLVLLKLERSVTLNQRVALICLPPEWYVVPPGTKCEIAGWGETKGTGNDTVLNVALLNVISNQECNIKHRGHVRESEMCTEGLLAPVGACEGDYGGPLACFTHNCWVLKGIRIPNRVCARSRWPAVFTRVSVFVDWIHKVMRLG

SEQ ID NO: 739864 - protein, 285 aa, Homo sapiens; identical to SEQ ID NO: 739863

SEQ ID NO: 739865 - protein, 285 aa, Homo sapiens; identical to SEQ ID NO: 739863

SEQ ID NO: 739866 - protein, 558 aa, Homo sapiens
FLDQGLDDNYCRNPDGSERPWCYTTDPQIEREFCDLPRCGSEAQPRQEATSVSCFRGKGEGYRGTANTTTAGVPCQRWDAQIPHQHRFTPEKYACKDLRENFCWNLDGSEAPWCFTLRPGTRVGFCYQIRRCTDDVRPQGEAQAWGLQSRGWKPGTGGPGRGLGLMAARTGRRLLPRRGGAVPRHGQQDPQGCPVPALVRCDAAQAAVSPWCSRPRQGPNPGAACFDVWDQSLEMVETTLPRFCSRSRLRFTFTSEPHAQLEENFCQTQMGIAMGPGATRWTQGPHSTTVPCDAALMTSRHQSWTPPDQVQFEKCGKRVDRLDQRRSKLRVAGGHPGNSPWTVSLRNRQGQHFCAGSLVKEQWILTARQCFSSCHMPLTGYEVWLGTLFQNPQHGEPGLQRVPVAKMLCGPSGSQLVLLKLERSVTLNQRVALICLPPEWYVVPPGTKCEIAGWGETKGTGNDTVLNVALLNVISNQECNIKHRGHVRESEMCTEGLLAPVGACEGDYGGPLACFTHNCWVLKGIRIPNRVCARSRWPAVFTRVSVFVDWIHKVMRLG

SEQ ID NO: 739867 - protein, 183 aa, Homo sapiens [sequence omitted]

SEQ ID NO: 739868 - protein, 183 aa, Homo sapiens [sequence omitted]

SEQ ID NO: 739869 - protein, 145 aa, Homo sapiens [sequence omitted]

SEQ ID NO: 739870 - protein, 107 aa, Homo sapiens
LPIPLTAGTGNDTVLNVALLNVISNQECNIKHRGHVRESEMCTEGLLAPVGACEGDYGGPLACFTHNCWVLKGIRIPNRVCARSRWPAVFTRVSVFVDWIHKVMRLG

SEQ ID NO: 739871 - protein, 92 aa, Homo sapiens
MGPGATRWTQGPHSTTVPCDAALMTSRHQSWTPPDQVQFEKCGKRVDRLDQRRSKLRVAGGHPGNSPWTVSLRNRHGAKQFSCRRGSPRLNC

SEQ ID NO: 739872 - protein, 331 aa, Homo sapiens
MFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGTYFARDAAYSSRFCKDDIKHGNTFQIHGVSLQQRHLFRTYKSMFLARVLIGDYINGDSKYMRPPSKDGSYVNLYDSCVDDTWNPKIFVVFDANQIYPEYLIDFH

SEQ ID NO: 739873 - protein, 338 aa, Homo sapiens
MWEANPEMFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGTYFARDAAYSSRFCKDDIKHGNTFQIHGVSLQQRHLFRTYKSMFLARVLIGDYINGDSKYMRPPSKDGSYVNLYDSCVDDTWNPKIFVVFDANQIYPEYLIDFH

SEQ ID NO: 739874 - protein, 331 aa, Homo sapiens; identical to SEQ ID NO: 739872

SEQ ID NO: 739875 - protein, 320 aa, Homo sapiens
MWEANPEMFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGTYFARDAAYSSRFCKDDIKHGNTFQIHGVSLQQRHLFRTYKSMFLARVLIGDYINGDSKYMRPPSKDGSYVNDANQIYPEYLIDFH

SEQ ID NO: 739876 - protein, 331 aa, Homo sapiens; identical to SEQ ID NO: 739872

SEQ ID NO: 739877 - protein, 351 aa, Homo sapiens
MQFTVKTCLPSGNLELQYQEMFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGTYFARDAAYSSRFCKDDIKHGNTFQIHGVSLQQRHLFRTYKSMFLARVLIGDYINGDSKYMRPPSKDGSYVNLYDSCVDDTWNPKIFVVFDANQIYPEYLIDFH

SEQ ID NO: 739878 - protein, 243 aa, Homo sapiens
MWEANPEMFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGRFALQSSSH

SEQ ID NO: 739879 - protein, 130 aa, Homo sapiens
IPRITRRRRLRGSVFPPRAGVSQLPADPEPALPPTALFVGGRKPQPPLDMFGACYKQPLKPSGSEPPAEECRMTPRHAGCDVTEMQRILSQPTFTEHLLRAVSCQRKGVPIQTPREHSWISCKKEFEANP

SEQ ID NO: 739880 - protein, 130 aa, Homo sapiens; identical to SEQ ID NO: 739879

SEQ ID NO: 739881 - protein, 163 aa, Homo sapiens
IPRITRRRRLRGSVFPPRAGVSQLPADPEPALPPTALFVGGRKPQPPLDMFGACYKQPLKPSGSEPPAEECRMTPRHAGCDVTEMQRILSQPTFTEHLLRAVCTKLANMYSTSTDCREHCRRGMKAKQLKAEAGRSCQRKGVPIQTPREHSWISCKKEFEANP

SEQ ID NO: 739882 - protein, 158 aa, Homo sapiens
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 739883 - protein, 117 aa, Homo sapiens
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSSV

SEQ ID NO: 739884 - protein, 50 aa, Homo sapiens
MPHMGPPLEQQSPRPESTDCGAQAGLAKCLLTQMEDSPPKPSSNDQHTCY

SEQ ID NO: 739885 - protein, 122 aa, Homo sapiens
SFVLLLADIESTCHVPVSNTALGTGNSRHRSLAFAQGAHRPVGANPEGHTACPFSAHRFWCELPLRVGEYWGGLPEEASFEPNLQRPSVYENCSRVLCTFSSTKVEAPTAPRNAPRQTLGAP

SEQ ID NO: 739886 - protein, 110 aa, Homo sapiens
GFAPDLRCTETGAFSPSWMPPENLTMPVTRLQTAGGTCRGLGMGGFGNLAPRTPSAKELRLLPRISRSTFGGTEGFRPGPEEFERLPGQAEAQPGEWRGCWATFRPSFPR

SEQ ID NO: 739887 - protein, 329 aa, Homo sapiens
MGGGPQWGDLLSLPLPPRGDAPPSSSAGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIAR

SEQ ID NO: 739888 - protein, 169 aa, Homo sapiens
GDWGVVGYQCAVACVRRLHGTPASIMERISASKGLISPMMARLAAAALKPSATFDPGEQAGSCPESRHLLDWGGHLASGCRAESGGVWKKCPCGPCLPAPPLCLIFAPILLVSMWGPWFWLPTVGGPCFCFPICELGAMVPASSAALHPWGHCRSPLPVCSPSHIPSPP

SEQ ID NO: 739889 - protein, 1194 aa, Homo sapiens
MGGGPQWGDLLSLPLPPRGDAPPSSSAGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQENDPCLATDCKYANKFHFHCLFGNCKYVCKTSGKAESHCLDHINPNNNLVNVRDQFAYYSLQCLCPNQHCEFRMRGHYHCLRTGCYFVTNITTKLPWHIKKHEKADGRAANGFKYFTKREECGRLGCKYNQVNSHFHCIREGCQFSFLLKHQMTSHARKHMRRMLGKNFDR

SEQ ID NO: 739890 - protein, 855 aa, Homo sapiens
MGGGPQWGDLLSLPLPPRGDAPPSSSAGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKVRAIHHTPPVPPPREIKAVLGGGGMCLFFNVLPLIR

SEQ ID NO: 739891 - protein, 1052 aa, Homo sapiens
ELPPEGVYMVQPQGCSDEEDHAEEPSKDGGALEEKDSDGAASKEDSGPSTRQASGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQEK

SEQ ID NO: 739892 - protein, 1025 aa, Homo sapiens
MGGGPQWGDLLSLPLPPRGDAPPSSSAGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQEK

SEQ ID NO: 739893 - protein, 865 aa, Homo sapiens
MGGGPQWGDLLSLPLPPRGDAPPSSSAGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGEQAGSCPESRHLLDWGGHLASGCRAESGGVWKKCPCGPCLPAPPLCLIFAPILLVSMWGPWFWLPTVGGPCFCFPICELGAMVPASSAALHPWGHCRSPLPVCSPSHIPSPP

SEQ ID NO: 739894 - protein, 106 aa, Homo sapiens
SAGAWSEADFSNMMSTHYPAPRHQVTTWSCPQAIVSPHGPVPGPPCHHMVLFSGHHVTTQSYSWVTMSLYGPVPKPSCDHVVLSSGLPCHHAVLSPGHHATLWSCP

SEQ ID NO: 739895 - protein, 78 aa, Homo sapiens
PVDPGDPGSRPGCTSGPLGVPQSRQKAHEEKVRFEGGEVTHLRQKNTNVPRRSGAWFSHRRKCLLISPCAGPPGPWRP

SEQ ID NO: 739896 - protein, 161 aa, Homo sapiens
LALHGLGGLCSCLGLTLLRGPSSSLAAPSSFLVFVLGFLVVHIVALLLAEFACHLGVWLWVPVQPLGERGAPKRPGSLAVSSSCLAAGGGSLLAPWRRPERGASCSASSAFVAAATTATGKTFFLKNVFLWPGVAAHACYLSTLGGQGGRITRSGEQDHPG

SEQ ID NO: 739897 - protein, 386 aa, Homo sapiens
MAQWHCSQRTQAGGHGVGERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 739898 - protein, 436 aa, Homo sapiens
PTPPPKLTLGLEGKRLTVRSFYSGTTLQAAMGPSTPLLILFLLSWSGPLQGQQHHLVEYMERRLAALEERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 739899 - protein, 69 aa, Homo sapiens
MLPLLEVAEKEREALRTEADTISGRVDRLEREVDYLETQNPALPCVEFDEKVTGGPGTKGKGRRNEKYD

SEQ ID NO: 739900 - protein, 227 aa, Homo sapiens
MRVAGAAKLVVAVAVFLLTFYVISQVFEIKMDASLGNLFARSALDTAARSTKPPRYKCGISKACPEKHFAFKMASGAANVVGPKICLEDNVLMSGVKNNVGRGINVALANGKTGEVLDTKYFDMWGGDVAPFIEFLKAIQDGTIVLMGTYDDGATKLNDEARRLIADLGSTSITNLGFRDNWVFCGGKGIKTKSPFEQHIKNNKDTNKYEGWPEVVEMEGCIPQKQD

SEQ ID NO: 739901 - protein, 197 aa, Homo sapiens [sequence omitted]

SEQ ID NO: 739902 - protein, 227 aa, Homo sapiens; identical to SEQ ID NO: 739900

SEQ ID NO: 739903 - protein, 227 aa, Homo sapiens; identical to SEQ ID NO: 739900

SEQ ID NO: 739904 - protein, 227 aa, Homo sapiens; identical to SEQ ID NO: 739900

SEQ ID NO: 739905 - protein, 114 aa, Homo sapiens
MRVAGAAKLVVAVAVFLLTFYVISQVFEIKMDASLGNLFARSALDTAARSTKPPRYKCGISKACPEKHFAFKMASGAANVVGPKICLEDNVLMSGVKNNVGRGINVALANGKSC

SEQ ID NO: 739906 - protein, 182 aa, Homo sapiens
MRVAATKPPRYKCGISKACPEKHFAFKMASGAANVVGPKICLEDNVLMSGVKNNVGRGINVALANGKTGEVLDTKYFDMWGGDVAPFIEFLKAIQDGTIVLMGTYDDGATKLNDEARRLIADLGSTSITNLGFRDNWVFCGGKGIKTKSPFEQHIKNNKDTNKYEGWPEVVEMEGCIPQKQD

SEQ ID NO: 739907 - protein, 227 aa, Homo sapiens; identical to SEQ ID NO: 739900

SEQ ID NO: 739908 - protein, 227 aa, Homo sapiens; identical to SEQ ID NO: 739900

SEQ ID NO: 739909 - protein, 670 aa, Homo sapiens
MEGERRAYSKEVHQRINKQLEEIRRLEEVRGDLQVQISAAQNQVKRLRDSQRLENMDRLLKGRAQVQAEIEELQEQTRALDKQIQEWETRIFTHSKNVRSPGFILDQKVKIRRRIRILENQLDRVTCHFDNQLVRNAALREELDLLRIDRNRYLNVDRKLKKEIHHLHHLVSTLILSSTSAYAVREEAKAKMGLLRERAEKEEAQSEMEAQVLQRQILHLEQLHHFLKLKNNDRQPDPDVLEKREKQAGEVAEGVWKTSQERLVLCYEDALNKLSQLMGESDPDLLVQKYLEIEERNFAEFNFINEQNLELEHVQEEIKEMQEALVSARASKDDQHLLQEQQQKVLQQRMDKVHSEAERLEARFQDVRGQLEKLKADIQLLFTKAHCDSSMIDDLLGVKTSMGDRDMGLFLSLIEKRLVELLTVQAFLHAQSFTSLADAALLVLGQSLEDLPKKMAPLQPPDTLEDPPGFEASDDYPMSREELLSQVEKLVELQEQAEAQRQKDLAAAAAKLDGTLSVDLASTQRAGSSTVLVPTRHPHAIPGSILSHKTSRDRGSLGHVTFGGLSSSTGHLPSHITHGDPNTGHVTFGSTSASSGGHVTFRPVSASSYLGSTGYVGSSRGGENTEGGVESGGTASDSSGGLGSSRDHVSSTGPASSTGPGSSTSKDSRG

SEQ ID NO: 739910 - protein, 694 aa, Homo sapiens
MEGERRAYSKEVHQRINKQLEEIRRLEEVRGDLQVQISAAQNQVKRLRDSQRLENMDRLLKGRAQVQAEIEELQEQTRALDKQIQEWETRIFTHSKNVRSPGFILDQKVKIRRRIRILENQLDRVTCHFDNQLVRNAALREELDLLRIDRNRYLNVDRKLKKEIHHLHHLVSTLILSSTSAYAVREEAKAKMGLLRERAEKEEAQSEMEAQVLQRQILHLEQLHHFLKLKNNDRQPDPDVLEKREKQAGEVAEGVWKTSQERLVLCYEDALNKLSQLMGESDPDLLVQKYLEIEERNFAEFNFINEQNLELEHVQEEIKEMQEALVSARASKDDQHLLQEQQQKVLQQRMDKVHSEAERLEARFQDVRGQLEKLKADIQLLFTKAHCDSSMIDDLLGVKTSMGDRDMGLFLSLIEKRLVELLTVQAFLHAQSFTSLADAALLVLGQSLEDLPKKMAPLQPPDTLEDPPGFEASDDYPMSREELLSQVEKLVRVGPAGVGPGLSVCRGPVHLSLQVELQEQAEAQRQKDLAAAAAKLDGTLSVDLASTQRAGSSTVLVPTRHPHAIPGSILSHKTSRDRGSLGHVTFGGLSSSTGHLPSHITHGDPNTGHVTFGSTSASSGGHVTFRPVSASSYLGSTGYVGSSRGGENTEGGVESGGTASDSSGGLGSSRDHVSSTGPASSTGPGSSTSKDSRG

SEQ ID NO: 739911 - protein, 736 aa, Homo sapiens
PCLARMPLGRLAGSARSEEGSEAFLEGMVDWELSRLQRQCKVMEGERRAYSKEVHQRINKQLEEIRRLEEVRGDLQVQISAAQNQVKRLRDSQRLENMDRLLKGRAQVQAEIEELQEQTRALDKQIQEWETRIFTHSKNVRSPGFILDQKVKIRRRIRILENQLDRVTCHFDNQLVRNAALREELDLLRIDRNRYLNVDRKLKKEIHHLHHLVSTLILSSTSAYAVREEAKAKMGLLRERAEKEEAQSEMEAQVLQRQILHLEQLHHFLKLKNNDRQPDPDVLEKREKQAGEVAEGVWKTSQERLVLCYEDALNKLSQLMGESDPDLLVQKYLEIEERNFAEFNFINEQNLELEHVQEEIKEMQEALVSARASKDDQHLLQEQQQKVLQQRMDKVHSEAERLEARFQDVRGQLEKLKADIQLLFTKAHCDSSMIDDLLGVKTSMGDRDMGLFLSLIEKRLVELLTVQAFLHAQSFTSLADAALLVLGQSLEDLPKKMAPLQPPDTLEDPPGFEASDDYPMSREELLSQVEKLVRVGPAGVGPGLSVCRGPVHLSLQVELQEQAEAQRQKDLAAAAAKLDGTLSVDLASTQRAGSSTVLVPTRHPHAIPGSILSHKTSRDRGSLGHVTFGGLSSSTGHLPSHITHGDPNTGHVTFGSTSASSGGHVTFRPVSASSYLGSTGYVGSSRGGENTEGGVESGGTASDSSGGLGSSRDHVSSTGPASSTGPGSSTSKDSRG

SEQ ID NO: 739912 - protein, 536 aa, Homo sapiens
LFLSLPISTVLPACISPSPLLLPSLWLSLSALLCISVSHLPYLPTPLCLCDSSLFVSLPWFLCGLPHLHFLWPSVCLSVSVLSVSVSLSPSLWAPPCPTLPVEERNFAEFNFINEQNLELEHVQEEIKEMQEALVSARASKDDQHLLQEQQQKVLQQRMDKVHSEAERLEARFQDVRGQLEKLKAVLECNGMISAHCNLRFLGSSDSPASASPVAGTTDIQLLFTKAHCDSSMIDDLLGVKTSMGDRDMGLFLSLIEKRLVELLTVQAFLHAQSFTSLADAALLVLGQSLEDLPKKMAPLQPPDTLEDPPGFEASDDYPMSREELLSQVEKLVRVGPAGVGPGLSVCRGPVHLSLQVELQEQAEAQRQKDLAAAAAKLDGTLSVDLASTQRAGSSTVLVPTRHPHAIPGSILSHKTSRDRGSLGHVTFGGLSSSTGHLPSHITHGDPNTGHVTFGSTSASSGGHVTFRPVSASSYLGSTGYVGSSRGGENTEGGVESGGTASDSSGGLGSSRDHVSSTGPASSTGPGSSTSKDSRG

SEQ ID NO: 739913 - protein, 497 aa, Homo sapiens
LFLSLPISTVLPACISPSPLLLPSLWLSLSALLCISVSHLPYLPTPLCLCDSSLFVSLPWFLCGLPHLHFLWPSVCLSVSVLSVSVSLSPSLWAPPCPTLPVEERNFAEFNFINEQNLELEHVQEEIKEMQEALVSARASKDDQHLLQEQQQKVLQQRMDKVHSEAERLEARFQDVRGQLEKLKAVLECNGMISAHCNLRFLGSSDSPASASPVAGTTDIQLLFTKAHCDSSMIDDLLGVKTSMGDRDMGLFLSLIEKRLVELLTVQAFLHAQSFTSLADAALLVLGQSLEDLPKKMAPLQPPDTLEDPPGFEASDDYPMSREELLSQVEKLVRVGPAGVGPGLSVCRGPVHLSLQVELQEQAEAQRQKDLAAAAAKLDGTLSVDLASTQRAGSSTVLVPTRHPHAIPGSILSHKTSRDRGSLGHVTFGGLSSSTGHLPSHITHGDPNTGHVTFGSISAPSLSAEPWPPVDPPPPVSGSLSSSPSPRLSTHPVSLSL

SEQ ID NO: 739914 - protein, 141 aa, Homo sapiens
QEALVSARASKDDQHLLQEQQQKVLQQRMDKVHSEAERLEARFQDVRGQLEKLKAGEHPWAPPPEPGFSTWKDTISPRGLEALHGQPGSLAYQLPHICPSFQPGSIPPTVPCPSIHPSSVPPTVLHPSIHPSINASIHPSR

SEQ ID NO: 739915 - protein, 197 aa, Homo sapiens
VFFSPNSQPGSHCRTAALLFLPMPLGLVSLLSLLHHLGSNSKHLCVPILAGSHVRSGRSVWKVLLGPCLHPRDLAMSPCSAVLKMPASASCAWGIFLEWWKAALPMCTVGERCQGVSTPQEQLLTSDPWYRSTRLYCSLGGIILKSTFDPVSQSFLGAVIHQGNWPHAILYQLLSFPESCLYSLLKHLSNKLLALSE

SEQ ID NO: 739916 - protein, 728 aa, Homo sapiens
HEVKSGGCGAGLVAAGAVRVLYPASRAGERTRVPGSPAPSSLPLHSPGACGTEVDMDPQRSPLLEVKGNIELKRPLIKAPSQLPLSGSRLKRRPDQMEDGLEPEKKRTRGLGATTKITTSHPRVPSLTTVPQTQGQTTAQKVSKKTGPRCSTAIATGLKNQKPVPAVPVQKSGTSGVPPMAGGKKPSKRPAWDLKGQLCDLNAELKRCRERTQTLDQENQQLQDQLRDAQQQVKALGTERTTLEGHLAKVQAQAEQGQQELKNLRACVLELEERLSTQEGLVQELQKKQVELQEERRGLMSQLEEKERRLQTSEAALSSSQAEVASLRQETVAQAALLTEREERLHGLEMERRRLHNQLQELKGNIRVFCRVRPVLPGEPTPPPGLLLFPSGPGGPSDPPTRLSLSRSDERRGTLSGAPAPPTRHDFSFDRVFPPGSGQDEVFEEIAMLVQSALDGYPVCIFAYGQTGSGKTFTMEGGPGGDPQLEGLIPRALRHLFSVAQELSGQGWTYSFVASYVEIYNETVRDLLATGTRKGQGGECEIRRAGPGSEELTVTNARYVPVSCEKEVDALLHLARQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVNQCVIGTAQANRK

SEQ ID NO: 739917 - protein, 728 aa, Homo sapiens; identical to SEQ ID NO: 739916

SEQ ID NO: 739918 - protein, 349 aa, Homo sapiens
PTQEFHPSLQCHRHKAGAVRVLYPASRAGERTRVPGSPAPSSLPLHDFSFDRVFPPGSGQDEVFEEIAMLVQSALDGYPVCIFAYGQTGSGKTFTMEGGPGGDPQLEGLIPRALRHLFSVAQELSGQGWTYSFVASYVEIYNETVRDLLATGTRKGQGGECEIRRAGPGSEELTVTNARYVPVSCEKEVDALLHLARQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVNQCVIGTAQANRK

SEQ ID NO: 739919 - protein, 72 aa, Homo sapiens
LLSPGTPQAFREDILPLSFMESHGIFCVDAAWAVREGPGPHVAAADPSPPQLSSLLCDVTALASLLWGGEYF

SEQ ID NO: 739920 - protein, 296 aa, Homo sapiens [sequence omitted]

SEQ ID NO: 739921 - protein, 218 aa, Homo sapiens
MYFDIPLEHRETSIIKRHPPQRLQKLEPIDLPRVITSGRLLSQREARTMHKAKQVLEKKMQTPMYTSENRQYLHKMQVLEMIRKRQEAQMELKKSLHGEARINKQSPRDHKAKKTLQSTPRNDDHDLLTMLPDEILNRGPGNSKNTEFLKHQAVNNCCPWKIGKMETWLHEQEAQGQLLWDSSSSDSDEQGKDEKKPRALVRTRTERIPLFDEFFDQE

SEQ ID NO: 739922 - protein, 170 aa, Homo sapiens
MHKAKQVLEKKMQTPMYTSENRQYLHKMQVLEMIRKRQEAQMELKKSLHGEARINKQSPRDHKAKKTLQSTPRNDDHDLLTMLPDEILNRGPGNSKNTEFLKHQAVNNCCPWKIGKMETWLHEQEAQGQLLWDSSSSDSDEQGKDEKKPRALVRTRTERIPLFDEFFDQE

SEQ ID NO: 739923 - protein, 220 aa, Homo sapiens
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLG

SEQ ID NO: 739924 - protein, 299 aa, Homo sapiens
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKGIIEARLFMSLSLAFCSRAPKTYLNLKSFAADFKLKTVGLWEIYSGLVLLAALLFRPHNLPVLSHLASWIQTLMTNFILEAPENTMAVQITVMHYGFGQAFFNFTRQSPRKLHRGPLTPDLCAKTPKWSSSLPDTRREVRRPGCGPPLGIPELENPGTRDQLLSTTIVSDRTAVEPGTL

SEQ ID NO: 739925 - protein, 634 aa, Homo sapiens
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHDPTDGCGMRHMDDSTWITEFQKTVEGALLFPVVEGKTNCAEQKATYNISTPDAALRKPVAREMCRHMNKAPAHCARNTMISTARKENMESTPVKETAQDNQKIQYHPGDSKETQGRNLEATEPRKEQRHQMEVAHTWDTKIRPTKYTLNGGQTTTQRPNGRDHQPVLPRTKHPTKTNYSKKRAENKKEPIEQTPWGVIHVGHTLARYMEQIRTDDGHSMMHQPEDRNERNNRSTNEAGTKRRTRHRHANNGRQRKTNTLSVRANRQGSHGANTRSENPTAQDQRSSTATDRRSAPKVQDSTKRPKTRRHNTEDRHTDSERKVNTRN

SEQ ID NO: 739926 - protein, 1290 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALPPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 739927 - protein, 1290 aa, Homo sapiens; identical to SEQ ID NO: 739926

SEQ ID NO: 739928 - protein, 821 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERG

SEQ ID NO: 739929 - protein, 903 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVSDLLLPHPLIALSPLLLGTSTASPRVLPDPPLPSPSCLFLLVLLPSRRLCLPTGTFLFYCALAPDTGDTPWFCSLWCCVPQVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERG

SEQ ID NO: 739930 - protein, 871 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGEVPKRCGEDEQSQEIPAVRGRGTQTFPEWILRSLGKGQEAVLTPLLSVPGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERG

SEQ ID NO: 739931 - protein, 761 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDIIMMEDLPGLAPGPAPSPAPSPTVAPDPAPDAYRPVGLTKAVLSLHTQKEEQAFLSRFRDLGRLRGLDSSSTAPSALGERG

SEQ ID NO: 739932 - protein, 695 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRDAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERG

SEQ ID NO: 739933 - protein, 1421 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGRIRPRWAGGMPRLAVPTGVWRTRAICPCVHGLTLLPPSASMPPSSAHPQLDPSCNLSLALFLSQINPLVPGSCDSSLKVPHLLSPPFCVGVRSSLWDLGLSSPWSACQGSVGSRGTNPRLRSLLTQSLPTGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALPPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 739934 - protein, 587 aa, Homo sapiens
LELLTSGDPPALASQSAGIKGVSHRARPTSASSCPLPSVFAVVCCDLIVGGVGGSLLKVPNAPLSFARGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERG

SEQ ID NO: 739935 - protein, 373 aa, Homo sapiens [sequence omitted]

SEQ ID NO: 739936 - protein, 373 aa, Homo sapiens [sequence omitted]

SEQ ID NO: 739937 - protein, 821 aa, Homo sapiens; identical to SEQ ID NO: 739928

SEQ ID NO: 739938 - protein, 373 aa, Homo sapiens [sequence omitted]

SEQ ID NO: 739939 - protein, 220 aa, Homo sapiens
MEGRDNRTRAPPASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 739940 - protein, 157 aa, Homo sapiens
LGALLLVPPRRRAGFLVLEALTSHSTSLGEEHEVGSCGRGRMPASWVLVRVLDPSLCLLNPFLGRDMTSVLKQDRERLRAMQKQQPRFSEDQRRELGAVHSWVRKGQLPRALDVMVREAWDGEKKELSSSSRGRKKELSSSSRDRGQELISLMSLDH

SEQ ID NO: 739941 - protein, 68 aa, Homo sapiens
CLSLLLHSQGFKLSGLGYGGGGRRQELIQSSLTYSRKLHQLDSILGPSPGVHERLSSPMSQFSELRCG

SEQ ID NO: 739942 - protein, 821 aa, Homo sapiens; identical to SEQ ID NO: 739928

SEQ ID NO: 739943 - protein, 929 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVSDLLLPHPLIALSPLLLGTSTASPRVLPDPPLPSPSCLFLLVLLPSRRLCLPTGTFLFYCALAPDTGDTPWFCSLWCCVPQVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERVLHDGPHPKRRTLRSKASVTHNRTSGE

SEQ ID NO: 739944 - protein, 232 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIA

SEQ ID NO: 739945 - protein, 116 aa, Homo sapiens
LLGYLPQDLLGAPVLLFLHPEDRPLMLAIHKKSEFLSPCSPFPLSWAFEWLPLWLCLLVPWSPGSLVAWPPSYSALPPFDRSSFPLPSVLQLAGQPFDHSPIRFCARNGEYVTMDT

SEQ ID NO: 739946 - protein, 608 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVSDLLLPHPLIALSPLLLGTSTASPRVLPDPPLPSPSCLFLLVLLPSRRLCLPTGTFLFYCALGP

SEQ ID NO: 739947 - protein, 628 aa, Homo sapiens
MARAGPRLVLSEEAVRAKSGLGPHRDLAELQSLSIPGTYQEKITHLGHSLMSLTGLKSLDLSRNSLVSLEGIQYLTALESLNLYYNCISSLAEVFRLHALTELVDVDFRLNPVVKVEPDYRLFVVHLLPKLQQLDDRPVRASERKASRLHFASEDSLDSKESVPASLKEGRPHHPRAKCTEALAKQSLVMDADDEAVLNLIAECEWDLGRPPGSTSFSQKGREADSRGSQESRHLLSPQLVQYQCGDSGKQGRETRRSSCRGCCLEKMPWSQLCGELPPLYGAEPEASRAPRPHTYFTPHPDSMDTEDSASSQKLDLSGEMVPGPLPAPGKCRKRRMPVGRFQTFSDQEGLGCPERTHGSSVPKESLSRQDSSESRNGRTLSQPEASETEEQRSRGVTDTREPSPGSHSALPGKKTALQVPAQQRGIPCSGKTHLVIFEEFTAAQDSSAMVGEDVGSLALESKSLQSRLAEQQQQHAREMSEVTAELHHTHKELDDLRQHLDKSLEENSRLKSLLLSMKKEVKSADTAATLNLQIAGLQTSVKRLCGEIVELKQHLEHYDKIQELTQMLQESHSSLVSTNEHLLQELSQVRAQHRAEVEQMHWSYQELKKTMALFPHSSASHGGCQAC

SEQ ID NO: 739948 - protein, 647 aa, Homo sapiens
MARAGPRLVLSEEAVRAKSGLGPHRDLAELQSLSIPGTYQEKITHLGHSLMSLTGLKSLDLSRNSLVSLEGIQYLTALESLNLYYNCISSLAEVFRLHALTELVDVDFRLNPVVKVEPDYRLFVVHLLPKLQQLDDRPVRASERKASRLHFASEDSLDSKESVPASLKEGRPHHPRAKCTEALAKQSLVMDADDEAVLNLIAECEWDLGRPPGSTSFSQKGREADSRGSQESRHLLSPQLVQYQCGDSGKQGRETRRSSCRGCCLEKMPWSQLCGELPPLYGAEPEASRAPRPHTYFTPHPDSMDTEDSASSQKLDLSGEMVPGPLPAPGKCRKRRMPVGRFQTFSDQEGLGCPERTHGSSVPKESLSRQDSSESRNGRTLSQPEASETEEQRSRGVTDTREPSPGSHSALPGKKTALQAALLETLLDLVDRSWGGCRSLHSNEAFLAQARHILSSVEEFTAAQDSSAMVGEDVGSLALESKSLQSRLAEQQQQHAREMSEVTAELHHTHKELDDLRQHLDKSLEENSRLKSLLLSMKKEVKSADTAATLNLQIAGLQTSVKRLCGEIVELKQHLEHYDKIQELTQMLQESHSSLVSTNEHLLQELSQVRAQHRAEVEQMHWSYQELKKTMALFPHSSASHGGCQAC

SEQ ID NO: 739949 - protein, 103 aa, Homo sapiens
MRSWNSQGAIQSLISLFSSFIHSIGVEPHLQGCSQGSGQWLGRRRQVGGSQWDTEGDGATEIGLCAGPGHLRAHAGRWAGPAGEGHTAGEDGSAKQPLPCCSA

SEQ ID NO: 739950 - protein, 647 aa, Homo sapiens; identical to SEQ ID NO: 739948

SEQ ID NO: 739951 - protein, 647 aa, Homo sapiens; identical to SEQ ID NO: 739948

SEQ ID NO: 739952 - protein, 344 aa, Homo sapiens
MDTEDSASSQKLDLSGEMVPGPLPAPGKCRKRRMPVGRFQTFSDQEGLGCPERTHGSSVPKESLSRQDSSESRNGRTLSQPEASETEEQRSRGVTDTREPSPGSHSALPGKKTALQAALLETLLDLVDRSWGGCRSLHSNEAFLAQARHILSSVEEFTAAQDSSAMVGEDVGSLALESKSLQSRLAEQQQQHAREMSEVTAELHHTHKELDDLRQHLDKSLEENSRLKSLLLSMKKEVKSADTAATLNLQIAGLQTSVKRLCGEIVELKQHLEHYDKIQELTQMLQESHSSLVSTNEHLLQELSQVRAQHRAEVEQMHWSYQELKKTMALFPHSSASHGGCQAC

SEQ ID NO: 739953 - protein, 70 aa, Homo sapiens
PPNHSASSPASQTAGFSKPSFLLSVSSAELHVPLLLLPILPFFCPQNTVEDDVLPNCSFGLSYNVNPFIL

SEQ ID NO: 739954 - protein, 34 aa, Homo sapiens
MGYAARVIYFSSSLFPDKAKVLERGFFSDRMTHT

SEQ ID NO: 739955 - protein, 70 aa, Homo sapiens
GTLAASPHRSGRATWLGGAGKAGPSLLTASSHRRKAISTRSGYNTEGRLNREQCCYHENDNLSLEEAPCH

SEQ ID NO: 739956 - protein, 141 aa, Homo sapiens
MRCRKTLSALPLAPVTDPVDPPLIFSLNWDGHSTGAQALLLLFPSCSFPPWSLRQHHGCPLSLHANIPQGIQKLLLREHLQADKLSSLLSFRGQIWEAFCRPPQRSRGITPVASILSLLLASPGFPSHCPLSFRSASWDHL

SEQ ID NO: 739957 - protein, 71 aa, Homo sapiens
EAILAKLEEFHQTDRTTQISPCLTHSRGSRQVCGLEALLEWMEFGLMKQIEEQELDCKDLSPPLNKAYHLQ

SEQ ID NO: 739958 - protein, 268 aa, Homo sapiens [sequence omitted]

SEQ ID NO: 739959 - protein, 268 aa, Homo sapiens [sequence omitted]

SEQ ID NO: 739960 - protein, 126 aa, Homo sapiens
MTSYRPRWGEMRGPWGCIGIHTGSCVPVCIGWIHIREQETGGLSPESVSSSSQGVWATVMIRGCGGEKGCVASLPSVLYPLWIDTQFSPPLLQVSETQASVSVFIRALLGYNSHTIKFTLLTTEWL

SEQ ID NO: 739961 - protein, 268 aa, Homo sapiens [sequence omitted]

SEQ ID NO: 739962 - protein, 174 aa, Homo sapiens
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLVLAKHFEPQDAKAVLQLLRQEHEERLQKISLEHLEQLAQYLLAEEPHVEPAGERELEAKARPQSSCDMEEKEEAAADQ

SEQ ID NO: 739963 - protein, 78 aa, Homo sapiens
PRGPLIQRLAALGVRGPAGPLETPMRNELMLDARAPWAQLPSAKRAPKAGSHFVLQAGVLRPQPPRFKGSCCLSPPSS

SEQ ID NO: 739964 - protein, 82 aa, Homo sapiens
PRGPLIQRLAALGVRGPAGPLETPMRNELMLDARAPWAQLPSAKRAPKAGEGKCRQAGYPEASEEMGGSEEPVVALDLLELG

SEQ ID NO: 739965 - protein, 79 aa, Homo sapiens
ETLVKLHGWAPPPLCDWLENSAGSVPPSVIGEEKGASEDSLASQDFPSLSKSHLFLLRCCLQKAHVKGPIFDQITWLLL

SEQ ID NO: 739966 - protein, 82 aa, Homo sapiens; identical to SEQ ID NO: 739964

SEQ ID NO: 739967 - protein, 604 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYTPDYDSFTLDSYTWPKEAMNVQTV

SEQ ID NO: 739968 - protein, 132 aa, Homo sapiens
MGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEVSGESFLPPAERT

SEQ ID NO: 739969 - protein, 604 aa, Homo sapiens; identical to SEQ ID NO: 739967

SEQ ID NO: 739970 - protein, 661 aa, Homo sapiens
VVGPLFEELTSSASSRPPARSTHWRERTHRPQLLTPPAPQRDRVDLSSPSSAGLPRTMGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYTPDYDSFTLDSYTWPKEAMNVQTV

SEQ ID NO: 739971 - protein, 448 aa, Homo sapiens
GWYAEWDIVEPTSLRLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYTPDYDSFTLDSYTWPKEAMNVQTV

SEQ ID NO: 739972 - protein, 263 aa, Homo sapiens [sequence omitted]

SEQ ID NO: 739973 - protein, 448 aa, Homo sapiens
RLKASSNFFLLELPGSPCGGVTPVLAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYTPDYDSFTLDSYTWPKEAMNVQTV

SEQ ID NO: 739974 - protein, 423 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGPRDFCQWKSF

SEQ ID NO: 739975 - protein, 217 aa, Homo sapiens
MFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYTPDYDSFTLDSYTWPKEAMNVQTV

SEQ ID NO: 739976 - protein, 217 aa, Homo sapiens; identical to SEQ ID NO: 739975

SEQ ID NO: 739977 - protein, 586 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNTGQLHLAQGSHECSDGLRQSQRLVWG

SEQ ID NO: 739978 - protein, 349 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGRFPPHLMKLQGTNLYSQPHWDAKGVRKGCHPIVGLLPAAVEK

SEQ ID NO: 739979 - protein, 213 aa, Homo sapiens
VVGPLFEELTSSASSRPPARSTHWRERTHRPQLLTPPAPQRDRVDLSSPSSAGLPRTMGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPR

SEQ ID NO: 739980 - protein, 70 aa, Homo sapiens
SSHLLVLPNNPGYLLEKKKTGTPGVGSVNGCCLFQELLRDPLYIGLKHQRVHGKAYDDLLDEFMQAVTDK

SEQ ID NO: 739981 - protein, 479 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDMDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 739982 - protein, 538 aa, Homo sapiens [sequence omitted]

SEQ ID NO: 739983 - protein, 570 aa, Homo sapiens [sequence omitted]

SEQ ID NO: 739984 - protein, 105 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQR

SEQ ID NO: 739985 - protein, 151 aa, Homo sapiens [sequence omitted]

SEQ ID NO: 739986 - protein, 114 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRFVCLFWFCS

SEQ ID NO: 739987 - protein, 81 aa, Homo sapiens
GAAGAPGRRAEAGGGGGRGARGVEAGGGRAGSVLCSVCQCWSRLQSVPGKKRLPTTRTLAYFLKIEEKKEDRKRRTQRYTK

SEQ ID NO: 739988 - protein, 511 aa, Homo sapiens [sequence omitted]

SEQ ID NO: 739989 - protein, 524 aa, Homo sapiens
GAAGAPGRRAEAGGGGGRGARGVEAGGGRAGSVLCSVCQCWSRLQSVPGKKMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDMDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 739990 - protein, 511 aa, Homo sapiens [sequence omitted]

SEQ ID NO: 739991 - protein, 479 aa, Homo sapiens; identical to SEQ ID NO: 739981

SEQ ID NO: 739992 - protein, 479 aa, Homo sapiens; identical to SEQ ID NO: 739981

SEQ ID NO: 739993 - protein, 479 aa, Homo sapiens; identical to SEQ ID NO: 739981

SEQ ID NO: 739994 - protein, 538 aa, Homo sapiens [sequence omitted]

SEQ ID NO: 739995 - protein, 233 aa, Homo sapiens
MLQINQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 739996 - protein, 83 aa, Homo sapiens
LTLAPVQMTFHAIGSSIEASHDQAALSALKQFSEQGLDPIDGAMNIEKGSLEKQAKHLREKADNNQAPPGSIAQDCKKSNSAV

SEQ ID NO: 739997 - protein, 137 aa, Homo sapiens
MANPKEKTAMCLVNELARFNRVQPQYKLLNERGPAHSKMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQR

SEQ ID NO: 739998 - protein, 523 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 739999 - protein, 407 aa, Homo sapiens
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 740000 - protein, 517 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEECVEKTDVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 740001 - protein, 407 aa, Homo sapiens; identical to SEQ ID NO: 739999

SEQ ID NO: 740002 - protein, 523 aa, Homo sapiens; identical to SEQ ID NO: 739998

SEQ ID NO: 740003 - protein, 307 aa, Homo sapiens
MEPAAALHFSLPASLLLLLLLLLLSLCALVSESFMPSASPWMVALAVILTASPWMVSMTVILAVFIIFMAVSICCIKKLQREKKILSGEKKVEQEEKEIAQQLQEECVEKTDVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 740004 - protein, 338 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRKVYVSIQVQWGHQWLQTS

SEQ ID NO: 740005 - protein, 168 aa, Homo sapiens
QDEKSVNDASSVSASQRISCIPKTHISNKYGNNFLQEAHMREKSFQCNESGKAFNCSSLLKKCQIIHLGEKKYKCDICGKVFNQKRYLAYHHRCHTGEKPYKCNQCGKTFSYKSSLVIHKAIHTGEKPHKCNECGKVFNQKAYLASHHRLHTGEKPYKCEECDKVFSR

SEQ ID NO: 740006 - protein, 118 aa, Homo sapiens
RDMHSQAPPGACVRRYEMRRPHCPRYQLQRWPVQVTDGLTASTDSEPAPPSLTAALSPSTPASLEFLALSPLGLARPSWLALRQFSAAAGRQGGARTHIQGPQASIFSPKSTSSVTKH

SEQ ID NO: 740007 - protein, 1013 aa, Homo sapiens
REVGSGKPRLSPSGRLPPASLRLRPGSERPELGKMRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 740008 - protein, 1013 aa, Homo sapiens; identical to SEQ ID NO: 740007

SEQ ID NO: 740009 - protein, 984 aa, Homo sapiens
REVGSGKPRLSPSGRLPPASLRLRPGSERPELGKMRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQNVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 740010 - protein, 669 aa, Homo sapiens
NRLGSEAWVVREKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 740011 - protein, 877 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQNVVGPALTFRIRHNEQNLSLADVTQQAGLVKSELEAQTGLQILQTGVGQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 740012 - protein, 536 aa, Homo sapiens
REVGSGKPRLSPSGRLPPASLRLRPGSERPELGKMRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPYAPVWKNGVEGRHTRLPLLLSPGPASDSHLGALPSLASRPASSHHPPTMRCSTSLLLAQENISRKNYFCTSVNKVSVLSVQLQKKKKKKRKKKKE

SEQ ID NO: 740013 - protein, 128 aa, Homo sapiens
REVGSGKPRLSPSGRLPPASLRLRPGSERPELGKMRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQE

SEQ ID NO: 740014 - protein, 877 aa, Homo sapiens
REVGSGKPRLSPSGRLPPASLRLRPGSERPELGKMRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQNVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYELAGRGHTGLHAAPAGLPQEGEQVLPGPLLPHHRALQ

SEQ ID NO: 740015 - protein, 66 aa, Homo sapiens
AVPRSTLAFAGAAVQTTQAGRRGLCKLSGPESCAGKLVRSGSCDCKLVRSGSCDCKLVRSGRVIVN

SEQ ID NO: 740016 - protein, 118 aa, Homo sapiens [sequence omitted]

SEQ ID NO: 740017 - protein, 118 aa, Homo sapiens [sequence omitted]

SEQ ID NO: 740018 - protein, 118 aa, Homo sapiens [sequence omitted]

SEQ ID NO: 740019 - protein, 118 aa, Homo sapiens [sequence omitted]

SEQ ID NO: 740020 - protein, 828 aa, Homo sapiens
MRLEGEGRSARAGQNLSRAGSARRGAPRDLSMNNLTELQPGLFHHLRFLEELRLSGNHLSHIPGQAFSGLYSLKILMLQNNQLGGIPAEALWELPSLQSLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 740021 - protein, 929 aa, Homo sapiens
ERRLWCKGKPTGQGMGRPRLTLVCHVSIIISARDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 740022 - protein, 87 aa, Homo sapiens
QAQWEHWKLTPFWATGMVLWLCLLTHLPKATGSPCAPFNSGDFLGLGPFFLCQEKWGALLSSSQCSGGMERSQGLSLPAHPASLAAL

SEQ ID NO: 740023 - protein, 105 aa, Homo sapiens
NKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 740024 - protein, 70 aa, Homo sapiens
LHCWSFLSPGAVILLTFSISPVMLVKVEDEAITGCTKGVEHLVISALGACSPQGFLELESYVGNMACIWK

SEQ ID NO: 740025 - protein, 110 aa, Homo sapiens
ISAAERRPGRRRRSRSSHGRDEAEGRRKGGEELSQSLRGAGFRGRHRGKRLSQPEEGQARSLSHLPRILSSPGSGDASASGPHRSCQPWRQLLLRGQRRGCPLHGIWIRL

SEQ ID NO: 740026 - protein, 364 aa, Homo sapiens
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRKKNLKEKA

SEQ ID NO: 740027 - protein, 210 aa, Homo sapiens
MLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRKKNLKEKA

SEQ ID NO: 740028 - protein, 256 aa, Homo sapiens
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKDLVCDYQSLKSVVQFLLLTGMLVGGIIGGHVSDRWLVESARWLIITNKLDEGLKALRKVARTNGIKNAEETLNIEVVRSTMQEELDAAQTKTTVCDLFRNPSMRKRICILVFLRKKNLKEKA

SEQ ID NO: 740029 - protein, 346 aa, Homo sapiens
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRVVRSTMQEELDAAQTKTTVCDLFRNPSMRKRICILVFLRKKNLKEKA

SEQ ID NO: 740030 - protein, 491 aa, Homo sapiens
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 740031 - protein, 416 aa, Homo sapiens
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVLLKPLRATSFAIVPQVPLALFVPALPF

SEQ ID NO: 740032 - protein, 66 aa, Homo sapiens
AKESLANARSLCHTSVVLRGHLAGSSSQPMAGCCKPHSLNAAPKILKINCKNKIKAGSEMVFLGLA

SEQ ID NO: 740033 - protein, 610 aa, Homo sapiens
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 740034 - protein, 549 aa, Homo sapiens [sequence omitted]

SEQ ID NO: 740035 - protein, 481 aa, Homo sapiens
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGGECDCRIPTHQPVLSGCSPRCLLRG

SEQ ID NO: 740036 - protein, 527 aa, Homo sapiens
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKWNVPVDSCWNAGSPFD

SEQ ID NO: 740037 - protein, 610 aa, Homo sapiens; identical to SEQ ID NO: 740033

SEQ ID NO: 740038 - protein, 401 aa, Homo sapiens
MWLPLVLLLAVLLLAVLCKVYLGLFSGSSPNPFSEDVKRPPAPLVTDKEARKKVLKQGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 740039 - protein, 610 aa, Homo sapiens; identical to SEQ ID NO: 740033

SEQ ID NO: 740040 - protein, 610 aa, Homo sapiens; identical to SEQ ID NO: 740033

SEQ ID NO: 740041 - protein, 269 aa, Homo sapiens
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYASL

SEQ ID NO: 740042 - protein, 259 aa, Homo sapiens
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSVSLTHLGNPVCQCEEGRH

SEQ ID NO: 740043 - protein, 516 aa, Homo sapiens
WAESEEHPSGARGTLCVAARSPQRNMALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 740044 - protein, 509 aa, Homo sapiens
GLEKLEPVLGKKILMPRNMALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSDGGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 740045 - protein, 401 aa, Homo sapiens
WAESEEHPSGARGTLCVAARSPQRNMALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGVSGGDKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 740046 - protein, 516 aa, Homo sapiens; identical to SEQ ID NO: 740043

SEQ ID NO: 740047 - protein, 516 aa, Homo sapiens; identical to SEQ ID NO: 740043

SEQ ID NO: 740048 - protein, 516 aa, Homo sapiens; identical to SEQ ID NO: 740043

SEQ ID NO: 740049 - protein, 133 aa, Homo sapiens
MTKVPATKKLQSSPNSGAVRPFYASENLRQVPDKPMKSIKYMDKEIINLKKDLIRSRLSHCRTQRRMGKRPNREATSKQERNDNEMFHLATLLDPTNIKEGIRIPLQKETPCFPREVISPSGTNSLTPYPSIK

SEQ ID NO: 740050 - protein, 164 aa, Homo sapiens [sequence omitted]

SEQ ID NO: 740051 - protein, 672 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRPSIHSQEMLGQFLQEVSVMAVMKT

SEQ ID NO: 740052 - protein, 543 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSLAPAASASLCISTAGPVTPSSTPSASISSRSQRVEGARTHPHCCCRSRC

SEQ ID NO: 740053 - protein, 513 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRSQRVEGARTHPHCCCRSRC

SEQ ID NO: 740054 - protein, 138 aa, Homo sapiens
MRAGRGATPARELFRDAAFPAADSSLFCDLSTPLAQFREDITWRRPQVPEGGRSQDAPPLLLQEPLLSCVPHRYAQEVSRLCLLPAGTYKVVPSTYLPDTEGAFTVTIATRIDRPSIHSQEMLGQFLQEVSVMAVMKT

SEQ ID NO: 740055 - protein, 112 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVRGPFPVFVLEPVSFCVSPAC

SEQ ID NO: 740056 - protein, 628 aa, Homo sapiens
IQVCVRVLCRPRCLWSTQLWPHRGRDTGVAPGGAYITLAFCFSCAWQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRPSIHSQEMLGQFLQEVSVMAVMKT

SEQ ID NO: 740057 - protein, 233 aa, Homo sapiens [sequence omitted]

SEQ ID NO: 740058 - protein, 444 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKGVTLGTTLFPVPSWMWPT

SEQ ID NO: 740059 - protein, 517 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVPEGGRSQDAPPLLLQEPLLSCVPHRYAQEVSRLCLLPAGTYKVVPSTYLPDTEGAFTVTIATRIDRPSIHSQEMLGQFLQEVSVMAVMKT

SEQ ID NO: 740060 - protein, 139 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVSCPVQLPADWTCKVQPVWLEFPCLPISCRLRVSSDTSPDSATWGSWK

SEQ ID NO: 740061 - protein, 625 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRTPYGGLTPRG

SEQ ID NO: 740062 - protein, 124 aa, Homo sapiens
MPGVFSLERLLCHTRALPGAWVKGQSAGGCRNNSGFPSNPKFWLRVSEPSEVYIAVLQRSRLHAADWAGRARALVGDSHTSWSPASIPGKHYQAVGLHLWKVTQPRLAHARFSRWCGGPWRSGF

SEQ ID NO: 740063 - protein, 105 aa, Homo sapiens
HTHISPQTVSAPRHLLQGLGDRAEVQRSRALLSQHISLGSEGQQQPHTVKLGSGTGLMQGSATPDTGIQLSSLPDQVSSTVCVASGCSDGEGCRLLGLGGQHPEP

SEQ ID NO: 740064 - protein, 126 aa, Homo sapiens
ERQLDLGTLNKVFASQWLNARQVVCGTKCNTLFVVDVQSGHITRIPLMRDKEAGLAQAQQGCGIHAIELNPSKTLLATGGENPNSLGHLPAAHPGPPVAWGDRHGHKDWIFAVAWLSDTVAVSGSR

SEQ ID NO: 740065 - protein, 292 aa, Homo sapiens
MTRTYENFQYLENKVKVQGFKNGPLPLQSLLQRLRSGPCHLLLSLGLGLLLLVIICVVGFQNSKFQRDLVTLRTDFSNFTSNTVAEIQALTSQGSSLEETIASLKAEVEGFKQERQAVHSEMLLRVQQLVQDLKKLTCQVATLNNNGEEASTEGTCCPVNWVEHQDSCYWFSHSGMSWAEAEKYCQLKNAHLVVINSREEQNFVQKYLGSAYTWMGLSDPEGAWKWVDGTDYATGFQNWKPGQPDDWQGHGLGGGEDCAHFHPDGRWNDDVCQRPYHWVCEAGLGQTSQESH

SEQ ID NO: 740066 - protein, 143 aa, Homo sapiens
MTRTYENFQYLENKVKVQGFKNGPLPLQSLLQRLRSGPCHLLLSLGLGLLLLVIICVVGFQNSKFQRDLVTLRTDFSNFTSNTVAEIQALTSQGSSLEETIASLKAEVEGFKQERQAGVSELQEHTTQKAHLGHCPHCPSVCV

SEQ ID NO: 740067 - protein, 118 aa, Homo sapiens
RQGLALLPRLEYSGVIMAHCSLRLLGINDSPTSASRVAGTTGTQHHTQLIFVFFVETGFCHVAQAGLELLASSDLPTLPPKMLGLRSEPPHPASVFLKLAILKIEAISLPLCFYSSNM

SEQ ID NO: 740068 - protein, 107 aa, Homo sapiens [sequence omitted]

SEQ ID NO: 740069 - protein, 113 aa, Homo sapiens
PSRKVTCTKSCSQQAIFVGQNYPTRIRQIIDKDRQPQEVEAFKGKILYQRHPQSMPHRDPVPHLNPTCQRQVTLVCPAVPISGKSTVFSDVPLLTGHKMHWKYLQGGKSPPTK

SEQ ID NO: 740070 - protein, 66 aa, Homo sapiens
SILSIDGEKLQEAERLLTPRTVGSTLQGETGFLRSPRRRVQAFSPLSRPPALPHPRSQRRTGFCFH

SEQ ID NO: 740071 - protein, 69 aa, Homo sapiens
LYVSCCRLLDLSRSPHHITQPLCPMGGQTVFQCRRKGCKVRAVCEEGTNESYCEKVCMVKKWITKNKAS

SEQ ID NO: 740072 - protein, 103 aa, Homo sapiens
LISSKVYQKGRKLEKWTGSYMKRTRDKWQKAIKEEDSRSLLCGGFYLCSHGFKPRLRESGHSAFTESLQCCWAATQYTTYIKKQNLTKVYVPIGINSTSRNLS

SEQ ID NO: 740073 - protein, 142 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPGEWTFACHLYE

SEQ ID NO: 740074 - protein, 301 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTLQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 740075 - protein, 307 aa, Homo sapiens
MACSFPEMEKPHSPLESWLSFSLYAGSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTLQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 740076 - protein, 103 aa, Homo sapiens
SVIVCSQFKIADHLSSKHTDRIEFQKGSSFRFLAHVQIHASGRKFQCTLSMLPSLGLVVNIQQSFMRKNVFCCMTEGFTKQTVVSIVSNMLHVHFRKQSPVIS

SEQ ID NO: 740077 - protein, 999 aa, Homo sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740078 - protein, 164 aa, Homo sapiens
QRAPRPGPAGARDAAESGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSPFSPL

SEQ ID NO: 740079 - protein, 106 aa, Homo sapiens
AWSLSWSHPQAWKNATLAEQAKLPATEKPVLLSNKAKFTKPRPRPKDKNGTRAEPPLNASASDQGEKVIPPAGQTEDAEPISEPEKVETGELEPMVEHVDVALAQG

SEQ ID NO: 740080 - protein, 1076 aa, Homo sapiens
RKEVAGVDGGAGRPPLLGETACELRGRVGSAREGRADAERSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740081 - protein, 1117 aa, Homo sapiens
RKEVAGVDGGAGRPPLLGETACELRGRVGSAREGRADAERSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSECSVGEGGLGNAAGLLIGVCSRLSCLNAWLSLAPTTFLPLRQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740082 - protein, 1076 aa, Homo sapiens; identical to SEQ ID NO: 740080

SEQ ID NO: 740083 - protein, 1194 aa, Homo sapiens
SGRGSGGGWRCGPATPPRGDSVRAPGAGRERKGEAARTPGGSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQVSSGWSQGSMEDGGEMQVVAAEEGGEGRPPLPCCVNHSLPRILWALSCFLTGAPKAHSPHCRCSSFVQLDCHSPSRPLTVSIQQSPVWNPHGVAVPSQACLEALLLIVPWGACGVSQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740084 - protein, 637 aa, Homo sapiens
YESKGIKAHFNLDESGVLSLDRVESVFETLVEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740085 - protein, 480 aa, Homo sapiens
RCESMSIGQSDSAIISAWASPGRFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740086 - protein, 1076 aa, Homo sapiens; identical to SEQ ID NO: 740080

SEQ ID NO: 740087 - protein, 1076 aa, Homo sapiens; identical to SEQ ID NO: 740080

SEQ ID NO: 740088 - protein, 1076 aa, Homo sapiens; identical to SEQ ID NO: 740080

SEQ ID NO: 740089 - protein, 163 aa, Homo sapiens
CCGDSKDLPGRPNTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740090 - protein, 1076 aa, Homo sapiens; identical to SEQ ID NO: 740080

SEQ ID NO: 740091 - protein, 64 aa, Homo sapiens
SCNFQRYEVLSHPCDLEVWRRGREGQLTGSFCSTSVVKNGNCSPPQPHSLFPTHIGPKFGKNHY

SEQ ID NO: 740092 - protein, 1007 aa, Homo sapiens
RKEVAGVDGGAGRPPLLGETACELRGRVGSAREGRADAERSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNAQVPARFV

SEQ ID NO: 740093 - protein, 695 aa, Homo sapiens
RKEVAGVDGGAGRPPLLGETACELRGRVGSAREGRADAERSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPYLRLGSPSSSIPSVAGARAAASAPRQE

SEQ ID NO: 740094 - protein, 696 aa, Homo sapiens
RKEVAGVDGGAGRPPLLGETACELRGRVGSAREGRADAERSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQVSSGWSQGSMEDGGGCR

SEQ ID NO: 740095 - protein, 179 aa, Homo sapiens
YESKGIKAHFNLDESGVLSLDRVESVFETLVEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKGARAAASAPRQE

SEQ ID NO: 740096 - protein, 128 aa, Homo sapiens
RHEGAQGTFKPLSGEGSCQPCPANSHSNTIVISRLPVPRLSQSWGRRSGGKRGTMADKVRRQRPRRRVCWALVAVLLADLLALSDTLAVMSVDLGSESMKVAIVKPGVPMEIVLNKESRCLEGFLNYI

SEQ ID NO: 740097 - protein, 85 aa, Homo sapiens
KSAHNSSNSTRVTFDYEVHIIHQAFNLCHVVSVGTEDLFERVPGPVQQALQSAEMSLDEIEQVILVGGATRVPRVQEVLLKAVGK

SEQ ID NO: 740098 - protein, 999 aa, Homo sapiens; identical to SEQ ID NO: 740077

SEQ ID NO: 740099 - protein, 788 aa, Homo sapiens
DFKAKVTRVEFEELCADLFERVLGLYSRPSIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740100 - protein, 647 aa, Homo sapiens
GYSEDPGAWGCTAGLQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740101 - protein, 1076 aa, Homo sapiens; identical to SEQ ID NO: 740080

SEQ ID NO: 740102 - protein, 461 aa, Homo sapiens
MDTDLSKPGLACSGLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740103 - protein, 1076 aa, Homo sapiens; identical to SEQ ID NO: 740080

SEQ ID NO: 740104 - protein, 144 aa, Homo sapiens
AWSLSWSHPQAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 740105 - protein, 1076 aa, Homo sapiens; identical to SEQ ID NO: 740080

SEQ ID NO: 740106 - protein, 1044 aa, Homo sapiens
RKEVAGVDGGAGRPPLLGETACELRGRVGSAREGRADAERSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEGISEPRILGLPKKFL

SEQ ID NO: 740107 - protein, 1096 aa, Homo sapiens
RKEVAGVDGGAGRPPLLGETACELRGRVGSAREGRADAERSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLNGGPGSSQRWNTIFIERVEIDTPSRSNTSLNETLGACERTAHFCDPKQRLRMARAHTHTPAEAPQTETRRQQIESAPGPEHEDATGATTSAQESTKDGREPRPKDQKREEPGEPEHRPEKTRRGKEAATEKGEHEPKRDDNRRTVSTPRDEQADMIARSSRHTGKDRRGLDKDSEGRERTTDT

SEQ ID NO: 740108 - protein, 611 aa, Homo sapiens
RKEVAGVDGGAGRPPLLGETACELRGRVGSAREGRADAERSASHRGARSSAPGLSPLAGAGRDPFPGVGAAAFVRGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKLVGQV

SEQ ID NO: 740109 - protein, 284 aa, Homo sapiens
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 740110 - protein, 284 aa, Homo sapiens; identical to SEQ ID NO: 740109

SEQ ID NO: 740111 - protein, 297 aa, Homo sapiens
MKTLSPDRIQPHIMTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 740112 - protein, 128 aa, Homo sapiens
MMSFENVKEKSREGGPHAHTPEEELCFVVTHYPQVQTTLNLFFHIFKVLTQPLSLLWGCDQKPRTVPTLGNGAWDTCQQHIRTSSWTANTLVIQNQHSRESTVSVCLFMLIRMQHILKTDTLQQFRIC

SEQ ID NO: 740113 - protein, 776 aa, Homo sapiens
MALADKRLENLQIYKVLQCVRNKDKKQIEKLTKLGYPELINYTEPINGLSALHLASVSNDIDMVSFLLDLGAHPDVQDRMGCTPTMRAAELGHELSMEILAKAKADMTIVDNEGKGVLFYCILPTKRHYRCALIALEHGADVNNSTYEGKPIFLRACEDAHDVKDVCLTFLEKGANPNAINSSTGRTALMEASREGVVEIVRGILERGGEVNAFDNDRHHAAHFAAKGGFFDILKLLFAYNGDVGLISINGNTPLHYAAMGGFADCCKYIAQRGCDLKWKNLDHKTPRAVAKEGGFKAASKEIRRAERIANKLARPGAKNPNPLWALRLHDWSVEREAFLREAFAVLDRGDGSISKNDFVMVLEERQDYASSEQLAAIAHLHEKTRGGGVNINEFFKGTRYLNKSFVLGSYGPKKKEKGMGKKGKKGKFVLPLPICVIPEYAFPRRQDGGPPYYMIETYKNVTDSSRFNRDHPPEHPIQDDSVWYIDDSEKVFSNINIITKAGDLASLKKAFESGIPVDMKDNYYKTPLMTACASGNIDVVKFLLEKGANVNATDNFLWTPLHFACHAGQQDIVELLVESGALIDAASINNSTPLNRAIESCRLDTVKYLLDIGAKFQLENRKGHSAMDVAKAYADYRIIDLIKEKLDNLPKPAENQKLKGKTPPILKTEGPEIKKEEELLSSIYGVPTTSEGKKVQKGNVVHLNSLITSGYTKKVDITFIPRRIWSPEATTAELIRKRELRRERFTHEVDFDDFMMPFQKNITEKARALEAALKT

SEQ ID NO: 740114 - protein, 791 aa, Homo sapiens
MALADKRLENLQIYKVLQCVRNKDKKQIEKLTKLGYPELINYTEPINGLSALHLASVSNDIDMVSFLLDLGAHPDVQDRMGCTPTMRAAELGHELSMEILAKAKADMTIVDNEGKGMCTQSSMPYASSMKGVLFYCILPTKRHYRCALIALEHGADVNNSTYEGKPIFLRACEDAHDVKDVCLTFLEKGANPNAINSSTGRTALMEASREGVVEIVRGILERGGEVNAFDNDRHHAAHFAAKGGFFDILKLLFAYNGDVGLISINGNTPLHYAAMGGFADCCKYIAQRGCDLKWKNLDHKTPRAVAKEGGFKAASKEIRRAERIANKLARPGAKNPNPLWALRLHDWSVEREAFLREAFAVLDRGDGSISKNDFVMVLEERQDYASSEQLAAIAHLHEKTRGGGVNINEFFKGTRYLNKSFVLGSYGPKKKEKGMGKKGKKGKFVLPLPICVIPEYAFPRRQDGGPPYYMIETYKNVTDSSRFNRDHPPEHPIQDDSVWYIDDSEKVFSNINIITKAGDLASLKKAFESGIPVDMKDNYYKTPLMTACASGNIDVVKFLLEKGANVNATDNFLWTPLHFACHAGQQDIVELLVESGALIDAASINNSTPLNRAIESCRLDTVKYLLDIGAKFQLENRKGHSAMDVAKAYADYRIIDLIKEKLDNLPKPAENQKLKGKTPPILKTEGPEIKKEEELLSSIYGVPTTSEGKKVQKGNVVHLNSLITSGYTKKVDITFIPRRIWSPEATTAELIRKRELRRERFTHEVDFDDFMMPFQKNITEKARALEAALKT

SEQ ID NO: 740115 - protein, 295 aa, Homo sapiens
MALADKRLENLQIYKVLQCVRNKDKKQIEKLTKLGYPELINYTEPINGLSALHLASVSNDIDMVSFLLDLGAHPDVQDRMGCTPTMRAAELGHELSMEILAKAKADMTIVDNEGKGVLFYCILPTKRHYRCALIALEHGADVNNSTYEGKPIFLRACEDAHDVKDVCLTFLEKGANPNAINSSTGRTALMEASREGVVEIVRGILERGGEVNAFDNDRHHAAHFAAKGGFFDILKLLFAYNGDVGLISINGNTPLHYAAMGGFADCCKYIAQRGCDLEWKNLDHIRRAERIASSR

SEQ ID NO: 740116 - protein, 776 aa, Homo sapiens; identical to SEQ ID NO: 740113

SEQ ID NO: 740117 - protein, 239 aa, Homo sapiens
MALADKRLENLQIYKVLQCVRNKDKKQIEKLTKLGYPELINYTEPINGLSALHLASVSNDIDMVSFLLDLGAHPDVQDRMGCTPTMRAAELGHELSMEILAKAKADMTIVDNEGKGVLFYCILPTKRHYRCALIALEHGADVNNSTYEGKPIFLRACEDAHDVKDVCLTFLEKGANPNAINSSTGRTALMEASREGVVEIVRGILERGGEVNAFDNDRHHAAHFAAKGGFFDVIIYSLL

SEQ ID NO: 740118 - protein, 95 aa, Homo sapiens
PIVDKIRTIAQAVYGAKDIELCPEAQVKIDRYTQQGFGNLPICMAKTDLSLSHQPDKKGVPRDFILPISDVRASIGAGFIYPLVGTGSRESPLWL

SEQ ID NO: 740119 - protein, 137 aa, Homo sapiens
PIVDKIRTIAQAVYGAKDIELCPEAQVKIDRYTQQGFGNLPICMAKTDLSLSHQPDKKGVPRDFILPISDVRASIGAGFIYPLVGTSRSVAQAKVQWHDLGSLQPPPPGFTPFSCLSLPSSRDYRHPPPHLANFLYF

SEQ ID NO: 740120 - protein, 427 aa, Homo sapiens [sequence omitted]

SEQ ID NO: 740121 - protein, 122 aa, Homo sapiens
LPNGSLPASVELALPGTALAMRLRHRQRALPTTLATASKPLFMPGTAPKDLAHAWDRPQGPHWLQSAAGRVVGEGMDTPWAGAGRTRPIIGHLVAMATTQGCLRLKICGLQGAPALALAESQ

SEQ ID NO: 740122 - protein, 276 aa, Homo sapiens
AKRAAWVRGLLIEFRRRGSLCRERAREMEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEEDEEGYNDGEVDDEEDEEELGEEERGQKRKREPEDEGEDDD

SEQ ID NO: 740123 - protein, 246 aa, Homo sapiens
AKRAAWVRGLLIEFRRRGSLCRERAREMEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEDDEEDEEELGEEERGQKRKREPEDEGEDDD

SEQ ID NO: 740124 - protein, 514 aa, Homo sapiens
NVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 740125 - protein, 85 aa, Homo sapiens
SGPFDCHLPDAIPSLRLPSWVLGPKVQSLSSPGALAIPWILRGKRAKSFTAGYCGDTRLPPASPTTNLDARSSHRNENLEVKGLE

SEQ ID NO: 740126 - protein, 444 aa, Homo sapiens
FNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 740127 - protein, 444 aa, Homo sapiens; identical to SEQ ID NO: 740126

SEQ ID NO: 740128 - protein, 444 aa, Homo sapiens; identical to SEQ ID NO: 740126

SEQ ID NO: 740129 - protein, 444 aa, Homo sapiens; identical to SEQ ID NO: 740126

SEQ ID NO: 740130 - protein, 444 aa, Homo sapiens; identical to SEQ ID NO: 740126

SEQ ID NO: 740131 - protein, 144 aa, Homo sapiens
RPPRPRWSCGPQSSIHTSPLPPPPISLSQPWAPGQVDSPRHSSTAFPGPGDPLQRRGSLRPGSRSADLPFFPASSGIVEAPYGDSSQSLFVGDRDRDKTMEVTGFGVTRCSSLPFPRHASCCRSLVKSLSLIPFLGDSSSLGLQ

SEQ ID NO: 740132 - protein, 428 aa, Homo sapiens
MGGLFSRWRTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 740133 - protein, 429 aa, Homo sapiens
MCWPSYLDERSGPSTVDVLESIDQEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 740134 - protein, 360 aa, Homo sapiens
DFCESEQTVPFYRVKPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 740135 - protein, 144 aa, Homo sapiens [sequence omitted]

SEQ ID NO: 740136 - protein, 428 aa, Homo sapiens; identical to SEQ ID NO: 740132

SEQ ID NO: 740137 - protein, 305 aa, Homo sapiens
MEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 740138 - protein, 428 aa, Homo sapiens; identical to SEQ ID NO: 740132

SEQ ID NO: 740139 - protein, 93 aa, Homo sapiens
GGGEGQPNPSLSPPSPESLEHDVLDDNTEQTDDKIPATEQTNQVIEKASDSEEPEEKQETENEEASVIETNSTVPGADSIPDPELSGESLTAE

SEQ ID NO: 740140 - protein, 240 aa, Homo sapiens
MGGLFSRWRTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGKQST

SEQ ID NO: 740141 - protein, 488 aa, Homo sapiens
MVRPLCRCPRAPPAAAALLPLGAAVAPPPAVAPPSPDRITVRETMSEETATSDNDNSYARVRAVVMTRDDSSGGWLPLGGSGLSSVTVFKVPHQEENGCADFFIRGERLRDKMVVLECMLKKDLIYNKVTPTFHHWKIDDKKFGLTFQSPADARAFDRGIRRAIEDISQGCPESKNEAEGADDLQANEEDSSSSLVKDHLFQQETVVTSEPYRSSNIRPSPFEDLNARRVYMQSQANQITFGQPGLDIQSRSMEYVQRQISKECGSLKSQNRVPLKSIRHVSFQDEDEIVRINPRDILIRRYADYRHPDMWKNDLERDDADSSIQFSKPDSKKSDYLYSCGDETKLSSPKDSVVFKTQPSSLKIKKSKRRKEDGERSRCVYCQERFNHEENVRGKCQDAPDPIKRCIYQVSCMLCAESMLYHCMSDSEGDFSDPCSCDTSDDKFCLRWLALVALSFIVPCMCCYVPLRMCHRCGEACGCCGGKHKAAG

SEQ ID NO: 740142 - protein, 488 aa, Homo sapiens; identical to SEQ ID NO: 740141

SEQ ID NO: 740143 - protein, 488 aa, Homo sapiens; identical to SEQ ID NO: 740141

SEQ ID NO: 740144 - protein, 488 aa, Homo sapiens; identical to SEQ ID NO: 740141

SEQ ID NO: 740145 - protein, 371 aa, Homo sapiens
MVRPLCRCPRAPPAAAALLPLGAAVAPPPAVAPPSPDRITVRETMSEETATSDNDNSYARVRAVVMTRDDSSGGWLPLGGSGLSSVTVFKVPHQEENGCADFFIRGERLRDKMVVLECMLKKDLIYNKVTPTFHHWKIDDKKFGLTFQSPADARAFDRGIRRAIEDISQGCPESKNEAEGADDLQANEEDSSSSLVKDHLFQQETVVTSEPYRSSNIRPSPFEDLNARRVYMQSQANQITFGQPGLDIQSRSMEYVQRQISKECGSLKSQNRVPLKSIRHVSFQDEDEIVRINPRDILIRRYADYRHPDMWKNDLERDDADSSIQFSKPDSKKSDYLYSCGDETKGFSEFALHSSHQVNTHKDKVMLCYPS

SEQ ID NO: 740146 - protein, 398 aa, Homo sapiens
MLGRSGYRALPLGDFDRFQQSSFGFLGSQKGCLSPERGGVGTGADVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 740147 - protein, 378 aa, Homo sapiens
MLGRSGYRALPLGDFDRFQQSSFGFLGSQKGCLSPERGGVGTGADVPQSWPSCLCHGLISFLGFLLLLVTFPISGWFALKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPGRGTSGTPGVPVGHPLMLLVGRCPMADLAAPAYAHDCWPGWPTLAWRVKVTGEPCFRPRWRGAQAMCRNNQGVDYRDPITRRSQPSWALIEKESMSPKKCPDKNRHQQTPNVDERTQLSSTHTTRAERQHATQHSATVDNKTIRSQRHTAVATPLLVDIAALMTT

SEQ ID NO: 740148 - protein, 348 aa, Homo sapiens
MLGRSGYRALPLGDFDRFQQSSFGFLGSQKGCLSPERGGVGTGADVPQSWPSCLCHGLISFLGFLLLLVTFPISGWFALKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 740149 - protein, 311 aa, Homo sapiens
MIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 740150 - protein, 398 aa, Homo sapiens; identical to SEQ ID NO: 740146

SEQ ID NO: 740151 - protein, 356 aa, Homo sapiens
MTDVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 740152 - protein, 401 aa, Homo sapiens
APAPPRVAARVKPEAAARRAGPRRAHWPGRAPRGGAGRVSCQKPCSADVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 740153 - protein, 499 aa, Homo sapiens
MLGRSGYRALPLGDFDRFQQSSFGFLGSQKGCLSPERGGVGTGADVPQSWPSCLCHGLISFLGFLLLLVTFPISGWFALKIVPTYERMIVFRLGRIRTPQGPGMVLLLPFIDSFQRVDLRTRAFNVPPCKVRGFSAALTEELGACPECTVVPGPQPVSHHLRGEGGRRDQKIDGSRRTSLLHTPNPTYLVTPFALEELAAKQVVQAGWPQWACPPCTPSPLSVSLSWLPQQLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 740154 - protein, 398 aa, Homo sapiens; identical to SEQ ID NO: 740146

SEQ ID NO: 740155 - protein, 106 aa, Homo sapiens
IDGASHGTGRQQADVRVGDYWLRSRYHSRSPSLFQVTGLGTKISAGEAGGGGGIKMTQLQPPILPFTEASPCSRHPEKCFVCIILVSPPSSLISRSCYRNTDETMG

SEQ ID NO: 740156 - protein, 106 aa, Homo sapiens; identical to SEQ ID NO: 740155

SEQ ID NO: 740157 - protein, 106 aa, Homo sapiens; identical to SEQ ID NO: 740155

SEQ ID NO: 740158 - protein, 116 aa, Homo sapiens
IVVFYCCTNITTNLVAENNTHLLFHSFCGSEVQAQLSSLQSCNQGVSEGWGLSLIRMLNWGKICFQIYPGCWQNSGPCFHRTESFIFLLAIGYRLPSAFRDHPEFLLGCCKPKIKF

SEQ ID NO: 740159 - protein, 106 aa, Homo sapiens
PSPPWPSHPARKHRLFAEFNPCLNICLFETRCLRGPHGQVRAHSWGRGGEAAEDWTCRFVSNSETPGGESWGQSMDRAHSVGSQTQDSPGFLIKRKETAVRSGSRL

SEQ ID NO: 740160 - protein, 96 aa, Homo sapiens
KRCSMRPQPDPKDPAPIGRLNSRARARKWRATGCSVAEFEYWFHSWLAVRPRASYHKTGRIPAPNSERSQAEMILLCEVRRAVLGTWSSELCSLFL

SEQ ID NO: 740161 - protein, 94 aa, Homo sapiens
KRCSMRPQPDPKDPAPIGRLNSRARARKWRATGCSVAEFEYWFHSWLAVRPRASYHKTGRIPAPNSERSQAEMILLCEVRRAVLGTWSSELYKN

SEQ ID NO: 740162 - protein, 145 aa, Homo sapiens
MLPSSIQISGEPLSGAEVRDICRGLRDNAVRLLSLRGCRLCDRDFGRICRALAGATSLAQLNLNLGVVSSPSRIKQLAEALRTNRSIQSLFLHGSPLTDAGLALLNPALALHPALVALDLGDCMLGDEAINLICGLLPPDGAKSG

SEQ ID NO: 740163 - protein, 316 aa, Homo sapiens
MLPSSIQISGEPLSGAEVRDICRGLRDNAVRLLSLRGCRLCDRDFGRICRALAGATSLAQLNLNLGVVSSPSRIKQLAEALRTNRSIQSLFLHGSPLTDAGLALLNPALALHPALVALDLGDCMLGDEAINLICGLLPPDGAKSGLKELTLSANPGITPKGWSRLAIAVAHSSQVRVLNLDYNPLGDHVAGMLAVAVASSRTLEVLDLEGTGLTNQSAQTLLDMVENYPTALRSLVLAENSISPELQQQICDLLSEGEEEEEVAGGAGDTQEWERGREPAAHQRGSSSWMCPSDPSSQMVLMTSGLGDSLLAETEM

SEQ ID NO: 740164 - protein, 95 aa, Homo sapiens
MDASVVVWSVSCIERVQLVSPVLVMDGGRRDLLQGGRRNGRIPGVQARDLFAQIAGAVRYLHDHHLVHRDSSGKRAAEPGRAPVKLTASVRPQAM

SEQ ID NO: 740165 - protein, 484 aa, Homo sapiens
MDLGKDQSHLKHHQTPDPHQEENHSPEVIGTWSLRNRELLRKRKAEVHEKETSQWLFGEQKKRKQQRTGKGNRRGRKRQQNTELKVEPQPQIEKEIVEKALAPIEKKTEPPGSITKVFPSVASPQKVVPEEHFSEICQESNIYQENFSEYQEIAVQNHSSETCQHVSEPEDLSPKMYQEISVLQDNSSKICQDMKEPEDNSPNTCQVISVIQDHPFKMYQDMAKREDLAPKMCQEAAVPKILPCPTSEDTADLAGCSLQAYPKPDVPKGYILDTDQNPAEPEEYNETDQGIAETEGLFPKIQEIAEPKDLSTKTHQESAEPKYLPHKTCNEIIVPKAPSHKTIQETPHSEDYSIEINQETPGSEKYSPETYQEIPGLEEYSPEIYQETSQLEEYSPEIYQETPGPEDLSTETYKNKDVPKECFPEPHQETGGPQGQDPKAHQEDAKDAYTFPQEMKEKPKEEPGIPAILNESHPENDVYSYVLF

SEQ ID NO: 740166 - protein, 484 aa, Homo sapiens; identical to SEQ ID NO: 740165

SEQ ID NO: 740167 - protein, 484 aa, Homo sapiens; identical to SEQ ID NO: 740165

SEQ ID NO: 740168 - protein, 484 aa, Homo sapiens; identical to SEQ ID NO: 740165

SEQ ID NO: 740169 - protein, 309 aa, Homo sapiens
MYQEISVLQDNSSKICQDMKEPEDNSPNTCQVISVIQDHPFKMYQDMAKREDLAPKMCQEAAVPKILPCPTSEDTADLAGCSLQAYPKPDVPKGYILDTDQNPAEPEEYNETDQGIAETEGLFPKIQEIAEPKDLSTKTHQESAEPKYLPHKTCNEIIVPKAPSHKTIQETPHSEDYSIEINQETPGSEKYSPETYQEIPGLEEYSPEIYQETSQLEEYSPEIYQETPGPEDLSTETYKNKDVPKECFPEPHQETGGPQGQDPKAHQEDAKDAYTFPQEMKEKPKEEPGIPAILNESHPENDVYSYVLF

SEQ ID NO: 740170 - protein, 358 aa, Homo sapiens
MDLGKDQSHLKHHQTPDPHQEENHSPEVIGTWSLRNRELLRKRKAEVHEKETSQWLFGEQKKRKQQRTGKGNRRGRKRQQNTELKVEPQPQIEKEIVEKALAPIEKKTEPPGSITKVFPSVASPQKVVPEEHFSEICQESNIYQENFSEYQEIAVQNHSSETCQHVSEPEDLSPKMYQEISVLQDNSSKICQDMKEPEDNSPNTCQVISVIQDHPFKMYQDMAKREDLAPKMCQEAAVPKILPCPTSEDTADLAGCSLQAYPKPDVPKGYILDTDQNPAEPEEYNETDQGIAETEGLFPKIQEIAEPKDLSTKTHQEDAKDAYTFPQEMKEKPKEEPGIPAILNESHPENDVYSYVLF

SEQ ID NO: 740171 - protein, 104 aa, Homo sapiens
NIHLKRIKKYLGLKNIHLKYTKKHPSLKNIHLKYTKKHRGLKTSLLRHIKIRMCLKNAFQNHTKKQVGPKARILKHTRKMLKMLILFLKVRAVYSTKVGTSPPE

SEQ ID NO: 740172 - protein, 81 aa, Homo sapiens
LAKPFCCDARTPYYGNDGCMVISMPIPYRISWPHRLVLGCSPIMERAVQTEVFCCLARWSSRLLIVSDLSSLRRSKQALDI

SEQ ID NO: 740173 - protein, 103 aa, Homo sapiens
MDVLVINMLTQSKYYWLSRVDVFGSDCTQIMERRGGRSEVLLDVLDRWKFYDVMILRYIRVETTRRAANIKIYRLLCMIYFTPLYNQSKGKIKLVSKTCFIIF

SEQ ID NO: 740174 - protein, 795 aa, Homo sapiens
METALAKTPQKRQVMFLAILLLLWEAGSEAVRYSIPEETESGYSVANLAKDLGLGVGELATRGARMHYKGNKELLQLDIKTGNLLLYEKLDREVMCGATEPCILHFQLLLENPVQFFQTDLQLTDINDHAPEFPEKEMLLKIPESTQPGTVFPLKIAQDFDIGSNTVQNYTISPNSHFHVATHNRGDGRKYPELVLDKALDREERPELSLTLTALDGGAPPRSGTTTIRIVVLDNNDNAPEFLQSFYEVQVPENSPLNSLVVVVSARDLDAGAYGSVAYALFQGDEVTQPFVIDEKTAEIRLKRALDFEATPYYNVEIVATDGGGLSGKCTVAIEVVDVNDNAPELTMSTLSSPTPENAPETVVAVFSVSDPDSGDNGRMICSIQNDLPFLLKPTLKNFYTLVTQRTLDRESQAEYNITITVTDMGTPRLKTEHNITVLVSDVNDNAPAFTQTSYTLFVRENNSPALHIGSVSATDRDSGTNAQVTYSLLPPQNPHLRLASLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFSMWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYHYEVCLTGDSGAGEFKFLKPIIPNLLPQGAGEEIGKTAAFRNSFGLN

SEQ ID NO: 740175 - protein, 201 aa, Homo sapiens
METALAKTPQKRQVMFLAILLLLWEAGSEAVRYSIPEETESGYSVANLAKDLGLGVGELATRGARMHYKGNKELLQLDIKTGNLLLYEKLDREVMCGATEPCILHFQLLLENPVQFFQTDLQLTDINDHAPEFPEKEMLLKIPESTQPGTVFPLKIAQDFDIGSNTVQNYTISPNSHFHVATHNRGDGRKYPELVLDKAPE

SEQ ID NO: 740176 - protein, 140 aa, Homo sapiens
GLLGAEELEGQGAQCWTAHPRPGLLAGACACKASSFPAARRGPPAPAAVPGPLAASQRRAERALRLLKRFGKAGGSEGGAGTSALSSGLPPGDPRPGRPRMDPSAECASCDRGRPLSPGRGQRARIKVLETQQSAASKWI

SEQ ID NO: 740177 - protein, 145 aa, Homo sapiens
MVYVEQQRHSGCVLTMTEWETAAPAVAETPDIKLFGKWSTDDVHISDISLQDYIAVKEKYAKYLPHSAGWYAAKCFHKAQCPCGRRISPEIRRDNGQTQRVIFRDSGVNPSKHPGGKTQRPEKPRGPVKTGAHHRQTVEHRAETH

SEQ ID NO: 740178 - protein, 1044 aa, Homo sapiens
IRVSALTPGRPDRELSLARLAGDRTGSGRPSVHPSGEKLQIRSPGMGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSINVPNIYQDTTISWWKDGKELLGGHHRITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPGVLTVPGLTEMAVFSCEAHNDKGLTVSQGVQINIKAIPSPPTEVSIRNSTAHSILISWVPGFDGYSPFRNCSIQVKEADPLGNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 740179 - protein, 422 aa, Homo sapiens
AITAGKGPGELSIKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 740180 - protein, 1061 aa, Homo sapiens
IRVSALTPGRPDRELSLARLAGDRTGSGRPSVHPSGEKLQIRSPGMGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSINVPNIYQDTTISWWKDGKELLGGHHRITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPGVLTVPGLTEMAVFSCEAHNDKGLTVSQGVQINIKAIPSPPTEVSIRNSTAHSILISWVPGFDGYSPFRNCSIQVKEADPLGNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCITHLAILARSPASCSYCRLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 740181 - protein, 1044 aa, Homo sapiens; identical to SEQ ID NO: 740178

SEQ ID NO: 740182 - protein, 792 aa, Homo sapiens
IRVSALTPGRPDRELSLARLAGDRTGSGRPSVHPSGEKLQIRSPGMGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSINVPNIYQDTTISWWKDGKELLGGHHRITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPGVLTVPGLTEMAVFSCEAHNDKGLTVSQGVQINIKAIPSPPTEVSIRNSTAHSILISWVPGFDGYSPFRNCSIQVKEADPLGNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCITHLAILARSPASCSYCR

SEQ ID NO: 740183 - protein, 175 aa, Homo sapiens
MGALVIRGIRNFNLENRAEREISKMKPSVAPRHPSTNSLLREQISLYPEVKGEIARKDEKLLSFLKDVYVDSKDPVSSLQVKAAETCQEPKEFRLPKDHHFDMINIKSIPKGKISIVEALTLLNNHKLFPETWTAEKIMQEYQLEQKDVNSLLKYFVTFEVEIFPPEDKKAIRSK

SEQ ID NO: 740184 - protein, 175 aa, Homo sapiens; identical to SEQ ID NO: 740183

SEQ ID NO: 740185 - protein, 175 aa, Homo sapiens; identical to SEQ ID NO: 740183

SEQ ID NO: 740186 - protein, 175 aa, Homo sapiens; identical to SEQ ID NO: 740183

SEQ ID NO: 740187 - protein, 132 aa, Homo sapiens
MCMLIPKILCLPCRAYDVVKDTAIKQMSNNVTIIMGKVKAAETCQEPKEFRLPKDHHFDMINIKSIPKGKISIVEALTLLNNHKLFPETWTAEKIMQEYQLEQKDVNSLLKYFVTFEVEIFPPEDKKAIRSK

SEQ ID NO: 740188 - protein, 168 aa, Homo sapiens
MGALVIRGIRNFNLENRAEREISKMKPSVAPRHPSTNSLLREQISREWCEGVSGPGGAESLCCPAVPSVGPEAEGSASACSAAAARVGGALEGGAARPVTLRLSSAPAVRSAAPPTSETQRQQPVLPLTRPSPAAVTDLIQGIKIREGHRAFSRGLHWTMDAEPDLEF

SEQ ID NO: 740189 - protein, 175 aa, Homo sapiens; identical to SEQ ID NO: 740183

SEQ ID NO: 740190 - protein, 175 aa, Homo sapiens; identical to SEQ ID NO: 740183

SEQ ID NO: 740191 - protein, 437 aa, Homo sapiens
HSLPSYTALLDLSHNNLSRLRAEWTPTRLTQLHSLLLSHNHLNFISSEAFSPVPNLRYLDLSSNQLRTLDEFLFSDLQVLEVLLLYNNHIMAVDRCAFDDMAQLQKLYLSQNQISRFPLELVKEGAKLPKLTLLDLSSNKLKNLPLPDLQKLPAWIKNGLYLHNNPLNCDCELYQLFSHWQYRQLSSVMDFQEDLYCMNSKKLHNVFNLSFLNCGEYKERAWEAHLGDTLIIKCDTKQQGMTKVWVTPSNERVLDEVTNGTVSVSKDGSLLFQQVQVEDGGVYTCYAMGETFNETLSVELKVHNFTLHGHHDTLNTAYTTLVGCILSVVLVLIYLYLTPCRCWCRGVEKPSSHQGDSLSSSMLSTTPNHDPMAGGDKDDGFDRRVAFLEPAGPGQGQNGKLKPGNTLPVPEATGKGQRRMSDPESVSSVFSDTPIVV

SEQ ID NO: 740192 - protein, 437 aa, Homo sapiens; identical to SEQ ID NO: 740191

SEQ ID NO: 740193 - protein, 412 aa, Homo sapiens
GGGGGCDMEPGAGGRNTARAQRAGSPNTPPPREQERKLEQEKLSGVVKSVHRRLRKKYREVGDFDKIWREHCEDEETLCEYAVAMKNLADNHWAKTCEGEGRIEWCCSVCREYFQNGGKRKALEKDEKRAVLATKTTPALNMHESSQLEGHLTNLSFTNPEFITELLQASGKIRLLDVGSCFNPFLKFEEFLTVGIDIVPAVESVYKCDFLNLQLQQPLQLAQDAIDAFLKQLKNPIDSLPGELFHVVVFSLLLSYFPSPYQRWICCKKAHELLVLNGLLLIITPDSSHQNRHAMMMKSWKIAIESLGFKRFKYSKFSHMHLMAFRKISLKTTSDLVSRNYPGMLYIPQDFNSIEDEEYSNPSCYVRSDIEDEQLAYGFTELPDAPYDSDSGESQASSIPFYELEDPILLLS

SEQ ID NO: 740194 - protein, 412 aa, Homo sapiens; identical to SEQ ID NO: 740193

SEQ ID NO: 740195 - protein, 249 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEEDEEGYNDGEVDDEEDEEELGEEERGQKRKREPEDEGEDDD

SEQ ID NO: 740196 - protein, 200 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEEGYNDGEVDDEEDYHTNHK

SEQ ID NO: 740197 - protein, 114 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKLIFF

SEQ ID NO: 740198 - protein, 159 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLVSHSDPPLPAGVGGGRNWHQQILLLHLSFSHLIFLTLMMCYEIELSYCFC

SEQ ID NO: 740199 - protein, 93 aa, Homo sapiens
MEMGRRIHLELRNRTPSDVKELVLDNSRSNEGKLEGLTDEFEELEFLSTINVGLTSIANLPKLNKLKKPETYFFLIVTLLWGWNKILFLLPKK

SEQ ID NO: 740200 - protein, 208 aa, Homo sapiens
RQYSAYVARLGGKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEERMKKVITMDEVRCTRTDELKTLAEDEHGVTPRTTSSPWKRLTGDATTGRPYCWTLQRTYGRTCRDQSHSARVQYTTARQTHRHATAKPPTNPAPTPP

SEQ ID NO: 740201 - protein, 249 aa, Homo sapiens; identical to SEQ ID NO: 740195

SEQ ID NO: 740202 - protein, 249 aa, Homo sapiens; identical to SEQ ID NO: 740195

SEQ ID NO: 740203 - protein, 249 aa, Homo sapiens; identical to SEQ ID NO: 740195

SEQ ID NO: 740204 - protein, 249 aa, Homo sapiens; identical to SEQ ID NO: 740195

SEQ ID NO: 740205 - protein, 249 aa, Homo sapiens; identical to SEQ ID NO: 740195

SEQ ID NO: 740206 - protein, 249 aa, Homo sapiens; identical to SEQ ID NO: 740195

SEQ ID NO: 740207 - protein, 256 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEVSVLSPEEDEEGYNDGEVDDEEDEEELGEEERGQKRKREPEDEGEDDD

SEQ ID NO: 740208 - protein, 205 aa, Homo sapiens
MQFTQINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEEDEEGYNDGEVDDEEDEEELGEEERGQKRKREPEDEGEDDD

SEQ ID NO: 740209 - protein, 199 aa, Homo sapiens
QDFELAGTPRIYKLTTEKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEEDEEGYNDGEVDDEEDEEELGEEERGQKRKREPEDEGEDDD

SEQ ID NO: 740210 - protein, 201 aa, Homo sapiens
LEELGSLPQSKLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEEDEEGYNDGEVDDEEDEEELGEEERGQKRKREPEDEGEDDD

SEQ ID NO: 740211 - protein, 260 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDGMAGGGGIKYYFYCHSLFFSPTFSLCPVFVPVNAIAKYTLSEHLFLTLKEDGLEFSYVSWYFPSLLGWLEGCGWSQFGYSMPRRG

SEQ ID NO: 740212 - protein, 181 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDDKQRKY

SEQ ID NO: 740213 - protein, 212 aa, Homo sapiens
LEELGSLPQSKLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDGMAGGGGIKYYFYCHSLFFSPTFSLCPVFVPVNAIAKYTLSEHLFLTLKEDGLEFSYVSWYFPSLLGWLEGCGWSQFGYSMPRRG

SEQ ID NO: 740214 - protein, 226 aa, Homo sapiens [sequence omitted]

SEQ ID NO: 740215 - protein, 104 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSALVEGSSK

SEQ ID NO: 740216 - protein, 142 aa, Homo sapiens
INPLPPQQEWINQPVRVNVKREYDHMNGSRESPVDCSVSKCSKLVGGGESNPMNYNSYMDEKNGPPPPNMTTNERRVIVPAGNSRTRLPGRHSLPHSLGGREHLNLYLILYSLWNCKMEKAARQPGVVARACNPSTLRGQDG

SEQ ID NO: 740217 - protein, 104 aa, Homo sapiens
ERNLDPRHICNLRAPLWPSPQFLPCTRKGLSNRSSLVLGGLCYGPLKYAVLAEFICPALFTLAALMSSYGWYVFCSYSGHQQFFLQILCPAGYVCSFLFPQQHI

SEQ ID NO: 740218 - protein, 333 aa, Homo sapiens
GFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFKVKCADEVLYKHKPKREREKKVIIVEPENSNVWKPSKQKREEDPEDSLMKLQN

SEQ ID NO: 740219 - protein, 422 aa, Homo sapiens
GQLEISIMAASISGYTFSAVCFHSANSNADHEGFLLGEVRQEETFSISDSQISNTEFLQVIEIHNHQPCSKLFSFYDYASKVNEESLDRILKDRRKKVIGWYRFRRNTQQQMSYREQVLHKQLTRILGVPDLVFLLFSFISTANNSTHALEYVLFRPNRRYNQRISLAIPNLGNTSQQEYKVSSVPNTSQSYAKVIKEHGTDFFDKDGVMKDIRAIYQVYNALQEKVQAVCADVEKSERVVESCQAEVNKLRRQITQRKNEKEQERRLQQAVLSRQMPSESLDPAFSPRMPSSGFAAEGRSTLGDAEASDPPPPYSDFHPNNQESTLSHSRMERSVFMPRPQAVGSSNYASTSAGLKYPGSGADLPPPQRAAGDSGEDSDDSDYENLIDPTEPSNSEYSHSKDSRPMAHPDEDPRNTQTSQI

SEQ ID NO: 740220 - protein, 311 aa, Homo sapiens
MSYREQVLHKQLTRILGVPDLVFLLFSFISTANNSTHALEYVLFRPNRRYNQRISLAIPNLGNTSQQEYKVSSVPNTSQSYAKVIKEHGTDFFDKDGVMKDIRAIYQVYNALQEKVQAVCADVEKSERVVESCQAEVNKLRRQITQRKNEKEQERRLQQAVLSRQMPSESLDPAFSPRMPSSGFAAEGRSTLGDAEASDPPPPYSDFHPNNQESTLSHSRMERSVFMPRPQAVGSSNYASTSAGLKYPGSGADLPPPQRAAGDSGEDSDDSDYENLIDPTEPSNSEYSHSKDSRPMAHPDEDPRNTQTSQI

SEQ ID NO: 740221 - protein, 422 aa, Homo sapiens; identical to SEQ ID NO: 740219

SEQ ID NO: 740222 - protein, 81 aa, Homo sapiens
QESTLSHSRMERSVFMPRPQAVGSSNYASTSAGLKYPGSGADLPPPQRAAGDSGEDSDDSDYENLIDQIRYTFSCLHDFVR

SEQ ID NO: 740223 - protein, 746 aa, Homo sapiens
DARAPAAARMELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEAGKSKIKASEDSLSVLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 740224 - protein, 729 aa, Homo sapiens
DARAPAAARMELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 740225 - protein, 323 aa, Homo sapiens
MAALIAENFRFLSLFFKSKDVMIFNGLVALGTVGSQELFSVVAFHCPCSPARNYLYGLAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQLFGWLLIGVVAILVFLTKCLKHYCSPLSYRQEAYWAQYRANEDQLFQRTAEVHSRVLAANNVRRFFGFVALNKDDEELIANFPVEGTQPRPQWNAITGVYLYRENQGLPLYSRLHKWAQGLAGNGAAPDNVEMALLPS

SEQ ID NO: 740226 - protein, 323 aa, Homo sapiens; identical to SEQ ID NO: 740225

SEQ ID NO: 740227 - protein, 323 aa, Homo sapiens; identical to SEQ ID NO: 740225

SEQ ID NO: 740228 - protein, 323 aa, Homo sapiens; identical to SEQ ID NO: 740225

SEQ ID NO: 740229 - protein, 323 aa, Homo sapiens; identical to SEQ ID NO: 740225

SEQ ID NO: 740230 - protein, 323 aa, Homo sapiens; identical to SEQ ID NO: 740225

SEQ ID NO: 740231 - protein, 323 aa, Homo sapiens; identical to SEQ ID NO: 740225

SEQ ID NO: 740232 - protein, 266 aa, Homo sapiens
MAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQLFGWLLIGVVAILVFLTKCLKHYCSPLSYRQEAYWAQYRANEDQLFQRTAEVHSRVLAANNVRRFFGFVALNKDDEELIANFPVEGTQPRPQWNAITGVYLYRENQGLPLYSRLHKWAQGLAGNGAAPDNVEMALLPS

SEQ ID NO: 740233 - protein, 323 aa, Homo sapiens; identical to SEQ ID NO: 740225

SEQ ID NO: 740234 - protein, 323 aa, Homo sapiens; identical to SEQ ID NO: 740225

SEQ ID NO: 740235 - protein, 323 aa, Homo sapiens; identical to SEQ ID NO: 740225

SEQ ID NO: 740236 - protein, 180 aa, Homo sapiens
GITATRACFSYPSRTCSFFHSLWGVGLRQFLAPPELCPFSGQLFGWLLIGVVAILVFLTKCLKHYCSPLSYRQEAYWAQYRANEDQLFQRTAEVHSRVLAANNVRRFFGFVALNKDDEELIANFPVEGTQPRPQWNAITGVYLYRENQGLPLYSRLHKWAQGLAGNGAAPDNVEMALLPS

SEQ ID NO: 740237 - protein, 323 aa, Homo sapiens; identical to SEQ ID NO: 740225

SEQ ID NO: 740238 - protein, 294 aa, Homo sapiens
MAALIAENFRFLSLFFKSKDVMIFNGLVALGTVGSQELFSVVAFHCPCSPARNYLYGLAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQLFGWLLIGVVAILVFLTKCLKHYCSPLSYRQEAYWAQYRANEDQLFQRTAEVHSRVLAANNVRRFFGFVALNKDDEELIANFPMLFVNGTTWSQTEPHCLLTSISEGDF

SEQ ID NO: 740239 - protein, 207 aa, Homo sapiens
MAALIAENFRFLSLFFKSKDVMIFNGLVALGTVGSQELFSVVAFHCPCSPARNYLYGLAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQLFGWLLIGVVAILVFLTKCLKH

SEQ ID NO: 740240 - protein, 81 aa, Homo sapiens
SAHPCPHPPVFAGLGLSTRTPSVSTSESSAGAGTGTGTSTPSTPTTTSQSRLIASSPNPVVPFQFYSELLRVRWATTVRWP

SEQ ID NO: 740241 - protein, 420 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRIHTGDRPYKCPHPGCEKAFTQLSNLQSHQRQHNKDKPYKCPNCYRAYSDSASLQIHLSAHAIKHAKAYCCSMCGRAYTSETYLMKHMSKHTVVEHLVSHHSPQRTESPGIPVRISLI

SEQ ID NO: 740242 - protein, 444 aa, Homo sapiens
RAGARARSLCRSPSPALLGPPGAGLRPRPGGAASTARMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRIHTGDRPYKCPHPGCEKAFTQLSNLQSHQRQHNKDKPYKCPNCYRAYSDSASLQIHLSAHAIKHAKAYCCSMCGRAYTSETYLMKHMSKHTVVEHLVSHHSPQRTESPGIPVRISLI

SEQ ID NO: 740243 - protein, 306 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRRPT

SEQ ID NO: 740244 - protein, 367 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRIHTGDRPYKCPHPGCEKAFTQLSNLQCLARTSRAVPWASLSRGVRQLQEAETRGVGDPQDQRVQ

SEQ ID NO: 740245 - protein, 66 aa, Homo sapiens
EPEPEPGACAGAPARPCSGRRARGCGRVPEAPPAQPGAVGNTEEVTGWGFRESSVEEGTLELGLEG

SEQ ID NO: 740246 - protein, 115 aa, Homo sapiens
VRLSEDPPRALTLVLPRISQDIQRRHSVQSGSPEIPRGFPGAMREKGAPGSSWQTRPPGSAWSNASSSFKGLFVFPAMEWESPAEALGPSAGKGSPGRQVPGADPAPSPHRHTPI

SEQ ID NO: 740247 - protein, 420 aa, Homo sapiens; identical to SEQ ID NO: 740241

SEQ ID NO: 740248 - protein, 422 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRIHTGDRPYKCPHPGCEKAFTQLSNLQSHQRQHNKDKPYKCPNCYRAYSDSASLQIRYPSTDSGICTWNTLVACNGKGHALLPGGGPLVPSRSGQGWQPQSQDDNKRKQTKMEESHPAGG

SEQ ID NO: 740249 - protein, 404 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRIHTGDRPYKCPHPGCEKAFTQLSNLQSHQRQHNKDKPYKCPNCYRAYSDSASLQIRYPSTDSGICRAAEPVATRSGERLLKNESQAGEGFILQSWGRRSSL

SEQ ID NO: 740250 - protein, 420 aa, Homo sapiens; identical to SEQ ID NO: 740241

SEQ ID NO: 740251 - protein, 303 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTR

SEQ ID NO: 740252 - protein, 332 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRWGSWRDGVRVGLGLGLEPGLLQEPSSGAETGPLGLRGRARVQRGGAFWRAPPTSQVPVRGGLLGRGIEAWTLRCGLWLAATPTAWGCESRFPPPFKQCSQPWPP

SEQ ID NO: 740253 - protein, 1547 aa, Homo sapiens
QRWSQPSAAPGGSGSSLSLCLSATMVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKGTHSGEFIYGLENFVYKDIKPGRKRKKHKKHFKKPFKGLDRSKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKKKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKVTSFISRILEY

SEQ ID NO: 740254 - protein, 1446 aa, Homo sapiens
QRWSQPSAAPGGSGSSLSLCLSATMVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKGTHSGEFIYGLENFVYKDIKPGRKRKKHKKHFKKPFKGLDRSKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKKKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRLWLL

SEQ ID NO: 740255 - protein, 1504 aa, Homo sapiens
QRWSQPSAAPGGSGSSLSLCLSATMVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKKKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKVTSFISRILEY

SEQ ID NO: 740256 - protein, 474 aa, Homo sapiens
FFFCILIQFKSVWLVHFNSFTTKLGGRDWLQFFCLLFFTDDQGIKISAASNFKLHIVLIFLDLDRFSILSLGCEQKVLDFLNFRRHGDKARREQARTGTACGDREKQIGICSLVMDPEETSVYLDYYYATSPNSDIRETHSHVPYTSVFLPVFYTAVFLTGVLGNLVLMGALHFKPGSRRLIDIFIINLAASDFIFLVTLPLWVDKEASLGLWRTGSFLCKGSSYMISVNMHCSVLLLTCMSVDRYLAIVWPVVSRKFRRTDCAYVVCASIWFISCLLGLPTLLSRELTLIDDKPYCAEKKATPIKLIWSLVALIFTFFVPLLSIVTCYCCIARKLCAHYQQSGKHNKKLKKSIKIIFIVVAAFLVSWLPFNTFKFLAIVSGLRQEHYLPSAILQLGMEVSGPLAFANSCVNPFIYYIFDSYIRRAIVHCLCPCLKNYDFGSSTETSDSHLTKALSTFIHAEDFARRRKRSVSL

SEQ ID NO: 740257 - protein, 129 aa, Homo sapiens
FFFCILIQFKSVWLVHFNSFTTKLGGRDWLQFFCLLFFTDDQGIKISAASNFKLHIVLIFLDLDRFSILSLGCEQKVLDFLNFRRHGDKARREQARTGTACGDREKQDRKRQTAFKAPGLTLEATPKWR

SEQ ID NO: 740258 - protein, 191 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTIFP

SEQ ID NO: 740259 - protein, 191 aa, Homo sapiens; identical to SEQ ID NO: 740258

SEQ ID NO: 740260 - protein, 191 aa, Homo sapiens; identical to SEQ ID NO: 740258

SEQ ID NO: 740261 - protein, 191 aa, Homo sapiens; identical to SEQ ID NO: 740258

SEQ ID NO: 740262 - protein, 191 aa, Homo sapiens; identical to SEQ ID NO: 740258

SEQ ID NO: 740263 - protein, 191 aa, Homo sapiens; identical to SEQ ID NO: 740258

SEQ ID NO: 740264 - protein, 191 aa, Homo sapiens; identical to SEQ ID NO: 740258

SEQ ID NO: 740265 - protein, 191 aa, Homo sapiens; identical to SEQ ID NO: 740258

SEQ ID NO: 740266 - protein, 191 aa, Homo sapiens; identical to SEQ ID NO: 740258

SEQ ID NO: 740267 - protein, 209 aa, Homo sapiens
MLRHVGEVSGPALAEIDLARSCSGYLQNKVRDQQLVYSAGVYRLPKTAADPSAEYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTIFP

SEQ ID NO: 740268 - protein, 191 aa, Homo sapiens; identical to SEQ ID NO: 740258

SEQ ID NO: 740269 - protein, 162 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRSSHCSGH

SEQ ID NO: 740270 - protein, 147 aa, Homo sapiens
SSCPPKAEAKAKALKAKKAVLKGATATKKMIHTSPTFQWPKTLRLWRQPKYPWKSAPRRNKLDHYAIIKFPLTTESAMKKIGDSNTLVFIVDVKANKHQIKQAVKKLYDIDMAKVNTLIRPDGEKKAYVPLAPDYDALDVANKIGII

SEQ ID NO: 740271 - protein, 349 aa, Homo sapiens
MALLRKINQVLLFLLIVTLCVILYKKVHKGTVPKNDADDESETPEELEEEIPVVICAAAGRMGATMAAINSIYSNTDANILFYVVGLRNTLTRIRKWIEHSKLREINFKIVEFNPMVLKGKIRPDSSRPELLQPLNFVRFYLPLLIHQHEKVIYLDDDVIVQGDIQELYDTTLALGHAAAFSDDCDLPSAQDINRLVGLQNTYMGYLDYRKKAIKDLGISPSTCSFNPGVIVANMTEWKHQRITKQLEKWMQKNVEENLYSSSLGGGVATSPMLIVFHGKYSTINPLWHIRHLGWNPDARYSEHFLQEAKLLHWNGRHKPWDFPSVHNDLWESWFVPDPAGIFKLNHHS

SEQ ID NO: 740272 - protein, 349 aa, Homo sapiens; identical to SEQ ID NO: 740271

SEQ ID NO: 740273 - protein, 146 aa, Homo sapiens
MGYLDYRKKAIKDLGISPSTCSFNPGVIVANMTEWKHQRITKQLEKWMQKNVEENLYSSSLGGGVATSPMLIVFHGKYSTINPLWHIRHLGWNPDARYSEHFLQEAKLLHWNGRHKPWDFPSVHNDLWESWFVPDPAGIFKLNHHS

SEQ ID NO: 740274 - protein, 349 aa, Homo sapiens; identical to SEQ ID NO: 740271

SEQ ID NO: 740275 - protein, 274 aa, Homo sapiens [sequence omitted]

SEQ ID NO: 740276 - protein, 756 aa, Homo sapiens
GSWSSLGPAGFAPAPPAFHSCPGRRVFKAGHTRLEIRDRAPPQALCTPLPGDLHWCSSVNMVQRYQSPVRVYKYPFELVMAAYEKRFPTCPQIPVFLGSEVLRESRSPDGAVHVVERSCRLRVDAPRLLRKIAGVEHVVFVQTNILNWKERTLLIEAHNETFANRVVVNEHCSYTVHPENEDWTCFEQSASLDIRSFFGFENALEKIAMKQYTANVKRGKEVIEHYLNELISQGTSHIPRWTPAPVREEDARNQAGPRDPSSLEAHGPRSTLGPALEAVSMDGDKLDADYIERCLGHLTPMQESCLIQLRHWLQETHKGKIPKDEHILRFLRAHDFHLDKAREMLRQSLSWRKQHQVDLLLQTWQPPALLEEFYAGGWHYQDIDGRPLYILRLGQMDTKGLMKAVGEEALLRHVLSVNEEGQKRCEGSTRQLGRPISSWTCLLDLEGLNMRHLWRPGVKALLRMIEVVEDNYPETLGRLLIVRAPRVFPVLWTLISPFINENTRRKFLIYSGSNYQGPGGLVDYLDREVIPDFLGGESVCNVPEGGLVPKSLYMTEEEQEHTDQLWQWSETYHSASVLRGAPHEVAVEILEGESVITWDFDILRGDVVFSLYHTKQAPRLGAREPGTRASGQLIDKGWVLGRDYSRVEAPLVCREGESIQGSHVTRWPGVYLLQWQMHSPPSSVACSLPGVDDVLTALHSPGPKCKLLYYCEVLASEDFRGSMSSLESCTSGFSQLSAATSSSSSGQSHSSSLVSR

SEQ ID NO: 740277 - protein, 96 aa, Homo sapiens
VGQPDTTIHTSNYLIRAMTRTAKPKPVCRGSTGSPGRAKSTQHHHTKEQLFRILLKLKNMKPQRGFLACLLWTQDCSKHSWILPFDPHNSHVFLCL

SEQ ID NO: 740278 - protein, 110 aa, Homo sapiens
PHLLLGEGPGGMEGVCGRLPRTTRRALFLLELEPAPGVFLGARALPLNGLCLQTICCADHEPSPQCQTDSSSGPAVPLGPLRKAQKPGTPNRVQLLPPALLGAAHLVTCV

SEQ ID NO: 740279 - protein, 105 aa, Homo sapiens
MLHLASIPTAAGLPASCFVKNGPDFHQTLIGLGLAFILPQPLHRLLATGCSLLQPGQCRSPGTDPGPGRPANSIALISHSAHQCWLPTPTAPPEGRFVSGLHHAL

SEQ ID NO: 740280 - protein, 328 aa, Homo sapiens
SEKENDPLRTPEALPEEKKIEYRLLKEEIANREKQRLIKSDQLKTSSSSPANSDVEIDGIGRIAMVTKQVTDAESKLKKHRILLMKDESVLKNLVQQEAKKKESVRNAEAKITKLTEQLQATEKILNVNRMFLKKLQEQIHRVQQRVTIKKALTLKYGEELARAKAVASKEIGKRKLEQDRFGPNKMMRLDSSPVSSPRKHSAELIAMEKRRLQKLEYEYALKIQKLKEARALKAKEQQNISPVVEEEPEFSLPQPSLHDLTQDKLTLDTEENDVDDEILSGSSRERRRSFLESNYFTKPNLKHTDTANKECINKLNKNTVEKPEKFL

SEQ ID NO: 740281 - protein, 158 aa, Homo sapiens
GEGEMAQPADSESGLSLLCKITFKSRPSLAPPAASSSLAAKASLGGGGGGGLFAASGAISYAEVLKQGPLPPGAARPLGEVSRGAQEAEGGDGDGEGCSGPPSAPASQARALPPPPYTTFPGSKPKFDWVSAPDGPERHFRFNGAGGGIGAPRRRAAA

SEQ ID NO: 740282 - protein, 104 aa, Homo sapiens
RRDLYGQCPRTVSDLALQNAFGDRWGPYFAEYDWCSTCSSSSESDNEGYFLGEPIPQPARLRYVTSDELLHKYSSYGLPKSSTLGGRGQLHSRKRQKSKNCIIS

SEQ ID NO: 740283 - protein, 202 aa, Homo sapiens
RLRPVRRALVAALPRASGRWGRQQRGRRHAGHGSLGGGEHSRLNPLRRLWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGGELALSAFLVLVFLWLHSLRRLFECLYVSVFSNVMIHVVQYCFGLVYYV

SEQ ID NO: 740284 - protein, 145 aa, Homo sapiens
VREKWSADMWRLGLPHLGSLQWAPTSGSSLRNPGKIPKTLVPHYCELVGANPKVRPNPARFLQNCRAPGGFMSNRFVETNPAIREQTVKSMLLLAPKLNEANLNVELMKHFARLQAKDEQGPIRCNTTVCLGKIGSYLSASRECP

SEQ ID NO: 740285 - protein, 643 aa, Homo sapiens
QAGHLRAQGQREVRAAQRSHSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPN

SEQ ID NO: 740286 - protein, 1232 aa, Homo sapiens
GFTRMWSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740287 - protein, 1204 aa, Homo sapiens
RPGTSERKDSARSAQPSAAMSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740288 - protein, 1153 aa, Homo sapiens
RPGTSERKDSARSAQPSAAMAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740289 - protein, 1064 aa, Homo sapiens
GFTRMWSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSLRVYGSESKPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740290 - protein, 1241 aa, Homo sapiens
GFTRMWSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEAASSYLFPQICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740291 - protein, 1275 aa, Homo sapiens
GFTRMWSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEGEAVALITYGLLGSEDMEDKPSPTSGAPHPATLPTHPPYPLFSVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740292 - protein, 549 aa, Homo sapiens
GFTRMWSPARTHSMMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDS

SEQ ID NO: 740293 - protein, 90 aa, Homo sapiens
RPRRVGGVKGRQMGLGLGVRSESLGDSCSPLSEDSLSFRSFPVFSPPGPPRKPPALSRVSRMFSVAHPAAKVPQPERLDLVYTALKRGLT

SEQ ID NO: 740294 - protein, 1149 aa, Homo sapiens
MRLESQFILVVAPFLRAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740295 - protein, 1220 aa, Homo sapiens
ALGAMPGAQAGWLEVASAGMVRVGVRAAVSGGLSRTHHEHQEERESPARTHSMMSLSVRPQRRLLSARVNRSQSFAGVLGSHERGPRAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740296 - protein, 1061 aa, Homo sapiens
MVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740297 - protein, 1243 aa, Homo sapiens
RPRRVGGVKGRQMGLGLGVRSESLGDSCSPLSEDSLSFRSFPVFSPPGPPRKPPALSRVSRMFSVAHPAAKVPQPERLDLVYTALKRGLTCSRSFQWGRWDPYRHGQQEILLQWYWAVVLLHGASWEEVRASWRREHFCRGLMGVPLQREPCTRKQRALPSRIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740298 - protein, 341 aa, Homo sapiens
LVGLVLNRHEGTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 740299 - protein, 36 aa, Homo sapiens
MKYGRQRWKLRGRIEGSGKQVWDSEETIFLPLLTEF

SEQ ID NO: 740300 - protein, 136 aa, Homo sapiens
QLKVKRRLQRQEGSVERCHSHKKKKIRTSPTFRRPKTLRLRRQPKHPRKSAPRRNKLDHYAIIKFPLTTESAMKKIEDNNTLVFIVDVKANKHQIKQAVKKLYDIDVAKVNTLIRPDGEKKAYVRLAIVHLVLFVF

SEQ ID NO: 740301 - protein, 111 aa, Homo sapiens
FLMEHRLDDAERGITKKPSCTHPQESVITFVKLRYYREVGCECQVESAEAFSNHFTLILPTKTCSKTIILVKSTTAFKLGHLKEQAPKLATRTSFLPGFSIQSQQMPARDT

SEQ ID NO: 740302 - protein, 475 aa, Homo sapiens
VTVLTHSKPSLIDYRKPSALKFEVVHMPQDRTEENEIFVDLALNVLPGLSTWQSVIKLNDFFVEIRGTLKMMCESFIYNQTLMKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKEMENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLACVATAIFLFTKCFLFSCQKFNKTRKIEKRE

SEQ ID NO: 740303 - protein, 507 aa, Homo sapiens
VTVLTHSKPSLIDYRKPSALKFEVVHMPQDRTEENEIFVDLALNVLPGLSTWQSVIKLNDFFVEIRGTLKMMCESFIYNQTLMKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKESYTRKPSSLKPWHLYLKRNTEGELTISIILYEMENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLACVATAIFLFTKCFLFSCQKFNKTRKIEKRE

SEQ ID NO: 740304 - protein, 414 aa, Homo sapiens
QLLPAGRSSAGCAGACPRSAVGNLPGHVGGAWAAPSVSVEARWLWPDWVAGVGAGWGLGEGRGAVGGGRGGMKLLQIFFGGIPAARSLRSARKVSSVPFLGAAGHQQSLPSSWKASCSGPLVMASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 740305 - protein, 292 aa, Homo sapiens
MASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 740306 - protein, 357 aa, Homo sapiens
QLLPAGRSSAGCAGACPRSAVGNLPGHVGGAWAAPSVSSVPFLGAAGHQQSLPSSWKASCSGPLVMASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 740307 - protein, 121 aa, Homo sapiens
TRFLPHIVPKDRLRIYFLKLNIKSQTLKLKKNLQANTTMNLKGVGFLNKMRRTYFIKENVDEFDYLEILNFFMMKGTINMKRQDIGNSVQLVCVQNTSIKEEQFKRNRKFTEEETGIVINK

SEQ ID NO: 740308 - protein, 152 aa, Homo sapiens [sequence omitted]

SEQ ID NO: 740309 - protein, 221 aa, Homo sapiens
MLAPCSGWELGCFRLCLRQVRLWAGAGRWACWACQARPYSSGGSERWPGSETEVPPPGPARRTLKEWTLQVSPFGRLRARLPCHLAVRPLDPLTYPDGDRVLVAVCGVEGGVRGLDGLQVKYDEDLEEMAIVSDTIHPQASVEVNAPLKFGLDIKSSGSGCVKVQSIEGDNCKIETEHGTSILQSVKGQKLHVQTKGGKVICLGTVYGNIDIHASDKSMVC

SEQ ID NO: 740310 - protein, 144 aa, Homo sapiens
MLAPCSGWELGCFRLCLRQVRLWAGAGRWACWACQARPYSSGGSERWPGSETEVPPPGPARRTLKEWTLQVSPFGRLRARLPCHLAVRPLDPLTYPDGDRVLVAVCGVEGGVRGLDGLQVKYDEDLEEMAIVSDTIHPQASVEV

SEQ ID NO: 740311 - protein, 129 aa, Homo sapiens
MGNITLQSKMGNITVDSSSGCLKASTNQGAIDVYVSQLGKVELKSHKGSIIVKVPSSLQAHLQLSGKEVDVNSEVHVQEMAEVRKDDVVTVTGLMNQASKREKWIKADAPKGTVSFRRQSWFQSLKLQD

SEQ ID NO: 740312 - protein, 144 aa, Homo sapiens; identical to SEQ ID NO: 740310

SEQ ID NO: 740313 - protein, 265 aa, Homo sapiens [sequence omitted]

SEQ ID NO: 740314 - protein, 189 aa, Homo sapiens
MLAPCSGWELGCFRLCLRQVRLWAGAGRWACWACQARPYSSGGSERWPGSETEVPPPGPARRTLKEWTLQVSPFGRLRARLPCHLAVRPLDPLTYPDGDRVLVAVCGVEGGVRGLDGLQVKYDEDLEEMAIVSDTIHPQASVEVNAPLKFGLDIKSSGSGCVKVQSIEGDNCKIETEHGTSILQSVKTS

SEQ ID NO: 740315 - protein, 1703 aa, Homo sapiens
MNQEGGGDGQKAPSFQWRNYKLIVDPALDPALRRPSQKVYRYDGVHFSVNDSKYIPVEDLQDPRCHVRSKNRDFSLPVPKFKLDEFYIGQIPLKEVTFARLNDNVRETFLKDMCRKYGEVEEVEILLHPRTRKHLGLARVLFTSTRGAKETVKNLHLTSVMGNIIHAQLDIKGQQRMKYYELIVNGSYTPQTVPTGGKALSEKFQGSGAATETAESRRRSSSDTAAYPAGTTAVGTPGNGTPCSQDTSFSSSRQDTPSSFGQFTPQSSQGTPYTSRGSTPYSQDSAYSSSTTSTSFKPRRSENSYQDAFSRRHFSASSASTTASTAIAATTAATASSSASSSSLSSSSSSSSSSSSSQFRSSDANYPAYYESWNRYQRHTSYPPRRATREEPPGAPFAENTAERFPPSYTPNWPPSPAATTGYGSCSEVTPGAPEPGGGGGGGGPSPEREEVRTSPRPASPARSGSPAPETTNESVPFAQHSSLDSRIEMLLKEQRSKFSFLASDTEEEEENSSMVLGARDTGSEVPSGSGHGPCTPPPAPANFEDVAPTGSGEPGATRESPKANGQNQASPCSSGDDMEISDDDRGGSPPPAPTPPQQPPPPPPPPPPPPPYLASLPLGYPPHQPAYLLPPRPNGPPPPEYPPPPPPPPHIYDFVNSLELMDRLGAQWGGMPMSFQMQTQMLTRLHQLRQGKGLIAASAGPPGGAFGEAFLPFPPPQEAAYGLPYALYAQGQEGRGAYSREAYHLPMPMAAEPLPSSSVSGEEARLPPREEAELAEGKTLPTAGTVGRVLAMLVQEMKSIMQRDLNRKMVENVAFGAFDQWWESKEEKAKPFQNAAKQQAKEEDKEKTKLKEPGLLSLVDWAKSGGTTGIEAFAFGSGLRGALRLPSFKVKRKEPSEISEASEEKRPRPSTPAEEDEDDPEQEKEAGEPGRPGTKPPKRDEERGKTQGKHRKSFALDSEGEEASQESSSEKDEEDDEEDEEDEDREEAVDTTKKETEVSDGEDEESDSSSKCSLYADSDGENDSTSDSESSSSSSSSSSSSSSSSSSSSSSSSESSSEDEEEEERPAALPSASPPPREVPVPTPAPVEVPVPERVAGSPVTPLPEQEASPARPAGPTEESPPSAPLRPPEPPAGPPAPAPRPDERPSSPIPLLPPPKKRRKTVSFSAIEVVPAPEPPPATPPQAKFPGPASRKAPRGVERTIRNLPLDHASLVKSWPEEVSRGGRSRAGGRGRLTEEEEAEPGTEVDLAVLADLALTPARRGLPALPAVEDSEATETSDEAERPRPLLSHILLEHNYALAVKPTPPAPALRPPEPVPAPAALFSSPADEVLEAPEVVVAEAEEPKPQQLQQQREEGEEEGEEEGEEEEEESSDSSSSSDGEGALRRRSLRSHARRRRPPPPPPPPPPRAYEPRSEFEQMTILYDIWNSGLDSEDMSYLRLTYERLLQQTSGADWLNDTHWVHHTITNLTTPKRKRRPQDGPREHQTGSARSEGYYPISKKEKDKYLDVCPVSARQLEGVDTQGTNRVLSERRSEQRRLLSAIGTSAIMDSDLLKLNQLKFRKKKLRFGRSRIHEWGLFAMEPIAADEMVIEYVGQNIRQMVADMREKRYVQEGIGSSYLFRVDHDTIIDATKCGNLARFINHCCTPNCYAKVITIESQKKIVIYSKQPIGVDEEITYDYKFPLEDNKIPCLCGTESCRGSLN

SEQ ID NO: 740316 - protein, 1613 aa, Homo sapiens
MNQEGGGDGQKAPSFQWRNYKLIVDPALDPALRRPSQKVYRYDGVHFSVNDSKYIPVEDLQDPRCHVRSKNRDFSLPVPKFKLDEFYIGQIPLKEVTFARLNDNVRETFLKDMCRKYGEVEEVEILLHPRTRKHLGLARVLFTSTRGAKETVKNLHLTSVMGNIIHAQLDIKGQQRMKYYELIVNGSYTPQTVPTGGKALSEKFQGSGAATETAESRRRSSSDTAAYPAGTTAVGTPGNGTPCSQDTSFSSSRQDTPSSFGQFTPQSSQGTPYTSRGSTPYSQDSAYSSSTTSTSFKPRRSENSYQDAFSRRHFSASSASTTASTAIAATTAATASSSASSSSLSSSSSSSSSSSSSQFRSSDANYPAYYESWNRYQRHTSYPPRRATREEPPGAPFAENTAERFPPSYTPNWPPSPAATTGYGSCSEVTPEPPEPGGGGGGGGPSPEREEVRTSPRPASPARSGSPAPETTNESVPFAQHSSLDSRIEMLLKEQRSKFSFLASDTEEEEENSSMVLGARDTGSEVPSGSGHGPCTPPPAPANFEDVAPTGSGEPGATRESPKANGQNQASPCSSGDDMEISDDDRGGSPPPAPTPPQQPPPPPPPPPPPPPYLASLPLGYPPHQPAYLLPPRPNGPPPPEYPPPPPPPPHIYDFVNSLELMDRLGAQWGGMPMSFQMQTQMLTRLHQLRQGKGLIAASAGPPGGAFGEAFLPFPPPQEAAYGLPYALYAQGQEGRGAYSREAYHLPMPMAAEPLPSSSVSGEEARLPPREEAELAEGKTLPTAGTVGRVLAMLVQEMKSIMQRDLNRKMVENVAFGAFDQWWESKEEKAKPFQNAAKQQAKEEDKEKTKLKEPGLLSLVDWAKSGGTTGIEAFAFGSGLRGALRLPSFKVKRKEPSEISEASEEKRPRPSTPAEEDEDDPEQEKEAGEPGRPGTKPPKRDEERGKTQGKHRKSFALDSEGEEASQESSSEKDEEDDEEDEEDEDREEAVDTTKKETEVSDGEDEESDSSSKCSLYADSDGENDSTSDSESSSSSSSSSSSSSSSSSSSSSSSSESSSEDEEEEERPAALPSASPPPREVPVPTPAPVEVPVPERVAGSPVTPLPEQEASPARPAGPTEESPPSAPLRPPEPPAGPPAPAPRPDERPSSPIPLLPPPKKRRKTVSFSAIEVVPAPEPPPATPPQAKFPGPASRKAPRGVERTIRNLPLDHASLVKSWPEEVSRGGRSRAGGRGRLTEEEEAEPGTEVDLAVLADLALTPARRGLPALPAVEDSEATETSDEAERPRPLLSHILLEHNYALAVKPTPPAPALRPPEPVPAAYEPRSEFEQMTILYDIWNSGLDSEDMSYLRLTYERLLQQTSGADWLNDTHWVHHTITNLTTPKRKRRPQDGPREHQTGSARSEGYYPISKKEKDKYLDVCPVSARQLEGVDTQGTNRVLSERRSEQRRLLSAIGTSAIMDSDLLKLNQLKFRKKKLRFGRSRIHEWGLFAMEPIAADEMVIEYVGQNIRQMVADMREKRYVQEGIGSSYLFRVDHDTIIDATKCGNLARFINHCCTPNCYAKVITIESQKKIVIYSKQPIGVDEEITYDYKFPLEDNKIPCLCGTESCRGSLN

SEQ ID NO: 740317 - protein, 830 aa, Homo sapiens
MRFHTKTQISGLSAVARCNLRLPGSSDSPASASRVAGVTGTRHHAWLIFVFLVELGFHCVGQAGLELLTSGDLPALASQSAGITGVSHRALPECLSSKQAPSFPIPQVKRKEPSEISEASEEKRPRPSTPAEEDEDDPEQEKEAGEPGRPGTKPPKRDEERGKTQGKHRKSFALDSEGEEASQESSSEKDEEDDEEDEEDEDREEAVDTTKKETEVSDGEDEESDSSSKCSLYADSDGENDSTSDSESSSSSSSSSSSSSSSSSSSSSSSSESSSEDEEEEERPAALPSASPPPREVPVPTPAPVEVPVPERVAGSPVTPLPEQEASPARPAGPTEESPPSAPLRPPEPPAGPPAPAPRPDERPSSPIPLLPPPKKRRKTVSFSAIEVVPAPEPPPATPPQAKFPGPASRKAPRGVERTIRNLPLDHASLVKSWPEEVSRGGRSRAGGRGRLTEEEEAEPGTEVDLAVLADLALTPARRGLPALPAVEDSEATETSDEAERPRPLLSHILLEHNYALAVKPTPPAPALRPPEPVPAAYEPRSEFEQMTILYDIWNSGLDSEDMSYLRLTYERLLQQTSGADWLNDTHWVHHTITNLTTPKRKRRPQDGPREHQTGSARSEGYYPISKKEKDKYLDVCPVSARQLEGVDTQGTNRVLSERRSEQRRLLSAIGTSAIMDSDLLKLNQLKFRKKKLRFGRSRIHEWGLFAMEPIAADEMVIEYVGQNIRQMVADMREKRYVQEGIGSSYLFRVDHDTIIDATKCGNLARFINHCCTPNCYAKVITIESQKKIVIYSKQPIGVDEEITYDYKFPLEDNKIPCLCGTESCRGSLN

SEQ ID NO: 740318 - protein, 1613 aa, Homo sapiens; identical to SEQ ID NO: 740316

SEQ ID NO: 740319 - protein, 94 aa, Homo sapiens
PAWAATAVPGTPRRAPESRAVAATGGGRAEESTGPPVQAAESGRPPTGKLRGAGAPGGPLAAGTRGPGLGFPHPGTLLSHNFGILKSEDSTKII

SEQ ID NO: 740320 - protein, 887 aa, Homo sapiens
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGSSWESIFNKSPEVVTPLQLQCCQRLVELCKQCLLVVYKYATDKRGSLSGIGPDWGNSRYLLPGSTQFFLRTPTYNLKYNSPGMTRSNVLFTSRYGHL

SEQ ID NO: 740321 - protein, 887 aa, Homo sapiens; identical to SEQ ID NO: 740320

SEQ ID NO: 740322 - protein, 749 aa, Homo sapiens
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKMKMFSVCMMMRMI

SEQ ID NO: 740323 - protein, 828 aa, Homo sapiens
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGLLPGSTQFFLRTPTYNLKYNSPGMTRSNVLFTSRYGHL

SEQ ID NO: 740324 - protein, 606 aa, Homo sapiens
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSKSISSNLDVI

SEQ ID NO: 740325 - protein, 612 aa, Homo sapiens
PLGQRQLFQALRVEHRSPEPWLPRAVGGRRRAPDHQCRLPSRGGRPRGSCEAREHLGDRLQRGREDPGWAFLTRINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGSSWESIFNKSPEVVTPLQLQCCQRLVELCKQCLLVVYKYATDKRGSLSGIGPDWGNSRYLLPGSTQFFLRTPTYNLKYNSPGMTRSNVLFTSRYGHL

SEQ ID NO: 740326 - protein, 665 aa, Homo sapiens
PLGQRQLFQALRVEHRSPEPWLPRAVGGRRRAPDHQCRLPSRGGRPRGSCEAREHLGDRLQRGREDPGWAFLTRELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGSSWESIFNKSPEVVTPLQLQCCQRLVELCKQCLLVVYKYATDKRGSLSGIGPDWGNSRYLLPGSTQFFLRTPTYNLKYNSPGMTRSNVLFTSRYGHL

SEQ ID NO: 740327 - protein, 354 aa, Homo sapiens
MPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGSSWESIFNKSPEVVTPLQLQCCQRLVELCKQCLLVVYKYATDKRGSLSGIGPDWGNSRYLLPGSTQFFLRTPTYNLKYNSPGMTRSNVLFTSRYGHL

SEQ ID NO: 740328 - protein, 124 aa, Homo sapiens
QGLEAGGVSWAMDIPTSSPCTLVAHDQGVFISMKKGLQEAVVAVAPNFGAPGWASCLWGHLGGQRSPPHQPILFYPFSVHCFFFFLLKGISRFFETLSGGHFGEDAIFLCHVMLFPHLTLAALS

SEQ ID NO: 740329 - protein, 80 aa, Homo sapiens
PLSLLLFNTILEVLARAIRQEKQIKGIHIGKEEVKLPLFTGNIILYLQNPKDQPKQLLELINYFSNISRCTKISRISTHQ

SEQ ID NO: 740330 - protein, 1082 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 740331 - protein, 1082 aa, Homo sapiens; identical to SEQ ID NO: 740330

SEQ ID NO: 740332 - protein, 1093 aa, Homo sapiens
DSEVYIKGGPRCCPRLPSSMVCTYDHAPGVLSSASYPQETQQSGLCLAGHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 740333 - protein, 937 aa, Homo sapiens
MMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 740334 - protein, 1110 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNTVSGPSPGRAGRSVSRGGAHRPVGLPVQESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 740335 - protein, 89 aa, Homo sapiens
PSVQPVSPPAIVSTSLAADLEGLTLTDSTLVPSVSGMEEGTGLGQGHIPVLHPMVWMCVGGGCDGGCDSFESQLLDGPRGQCWDRLSPS

SEQ ID NO: 740336 - protein, 262 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNISVAI

SEQ ID NO: 740337 - protein, 1191 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVSTTWGGIACPHLPQDHTQAWGEEGNDFSPWGPDLLRNVSEPGEDTVSMSLNWMWIKVKDPDTLRGALPHWESLSPWTAAGWGDDIPGVGGWAQVPAEKRSAEKRALPKVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 740338 - protein, 1103 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDCSLLNPSHLHFASSSVLSTPTVTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 740339 - protein, 689 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGETEARG

SEQ ID NO: 740340 - protein, 139 aa, Homo sapiens
AAGLPPFAFTLSSLFFPQLVAGSVVMAFEEVCPERIDLIHKNYRKLCNLLIDVEEWGQVVIISMLTRYARTQFLSPTQNTVSGPSPGRAGRSVSRGGAHRPVGLPVQESLLEENAEKAFYGSEEDEAKGAGSEETAAAA

SEQ ID NO: 740341 - protein, 375 aa, Homo sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 740342 - protein, 375 aa, Homo sapiens; identical to SEQ ID NO: 740341

SEQ ID NO: 740343 - protein, 375 aa, Homo sapiens; identical to SEQ ID NO: 740341

SEQ ID NO: 740344 - protein, 375 aa, Homo sapiens; identical to SEQ ID NO: 740341

SEQ ID NO: 740345 - protein, 120 aa, Homo sapiens
MDVTSQARGVGLEMYPGTAQPAAPNTTSPELNLSHPLLGTALANGTGELSEHQQYVIGLFLSCLYTIFLFPIGFVGNILILVVNISFREKMTIRTDFINWGGTQPGRPPARSPDNRIKAP

SEQ ID NO: 740346 - protein, 375 aa, Homo sapiens; identical to SEQ ID NO: 740341

SEQ ID NO: 740347 - protein, 285 aa, Homo sapiens
MTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 740348 - protein, 77 aa, Homo sapiens
VAEEWFRSSSGMRENPDPVSKGPQIGQCSPTLVWVGLLYAVYYTNSSANFFQKRPHRHTQKSHLPAIWAPPCPVKLT

SEQ ID NO: 740349 - protein, 120 aa, Homo sapiens
PGAAGTSRNPPHCSLEAAAPSEVAGGRRDGGARQVVQGLRRPQVQAGGQAGRQAAALGRGAALRRAAQGAGAASGLRGGAVGARCRRRAHKPVVVGERLGGRGDCWGDLAARQWQVVSSG

SEQ ID NO: 740350 - protein, 91 aa, Homo sapiens
KEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 740351 - protein, 655 aa, Homo sapiens
PEKPARPGRRRRAGPAHEAASAAMTAEKALPLGNGKAAEEARESEAPGGGCSSGGAAPARHPRVKRDKAVHERGHWNNKVEFVLSVAGEIIGLGNVWRFPYLCYKNGGGAFLIPYVVFFICCGIPVFFLETALGQFTSEGGITCWRKVCPLFEGIGYATQVIEAHLNVYYIIILAWAIFYLSNCFTTELPWATCGHEWNTENCVEFQKLNVSNYSHVSLQNATSPVMEFWEHRVLAISDGIEHIGNLRWELALCLLAAWTICYFCIWKGTKSTGKVVYVTATFPYIMLLILLIRGVTLPGASEGIKFYLYPDLSRLSDPQVWVDAGTQIFFSYAICLGCLTALGSYNNYNNNCYRDCIMLCCLNSGTSFVAGFAIFSVLGFMAYEQGVPIAEVAESGPGLAFIAYPKAVTMMPLSPLWATLFFMMLIFLGLDSQFVCVESLVTAVVDMYPKVFRRGYRRELLILALSVISYFLGLVMLTEGGMYIFQLFDSYAASGMCLLFVAIFECICIGWVYGSNRFYDNIEDMIGYRPPSLIKWCWMIMTPGICAGIFIFFLIKYKPLKYNNIYTYPAWGYGIGWLMALSSMLCIPLWICITVWKTEGTLPEKLQKLTTPSTDLKMRGKLGVSPRMVTVNDCDAKLKSDGTIAAITEKETHF

SEQ ID NO: 740352 - protein, 188 aa, Homo sapiens
SVSGWRKQTLLAIPLTHVQNFSGVCMFPSDLFRTGSNRFYDNIEDMIGYRPPSLIKWCWMIMTPGICAGIFIFFLIKYKPLKYNNIYTYPAWGYGIGWLMALSSMLCIPLWICITVWKTEGTLPEVRPPQEGWCVWAGFAPWVPVSSSAWCAMTACAHLPQGDAVANSSLANVQYHGCAQGVSVKSFG

SEQ ID NO: 740353 - protein, 90 aa, Homo sapiens
SEGQVLVLGATNRPHALDAALRRPGRFDKEIEIGVPNAQDRLDILQKLLRRVPHLLTEAELLQLANSAHGYVGADLKVLCNEAGECGLLW

SEQ ID NO: 740354 - protein, 305 aa, Homo sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 740355 - protein, 305 aa, Homo sapiens; identical to SEQ ID NO: 740354

SEQ ID NO: 740356 - protein, 222 aa, Homo sapiens
MSRELAPLLLLLLSIHSALAMRICSFNVRSFGESKQEDKNAMDVIVKVIKRCDIILVMEIKDSKKKKKKLETSPLSLSPSGRPEHRAIAFGRIRAARSNTRAARAQPGMMDIGRRLVGDNGLRAGGKGRARGAKIAPRAVFPSNLGGGPRHQRLWMVGPWLQERDPLWGPKEARDKKRLPHPGMYPYCSRVSSTVGSLGAILAHSSIRSGLWPRGPPCCDEA

SEQ ID NO: 740357 - protein, 218 aa, Homo sapiens
MKVVRKGLTQLGGLPFPSYREKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 740358 - protein, 119 aa, Homo sapiens
MGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 740359 - protein, 305 aa, Homo sapiens; identical to SEQ ID NO: 740354

SEQ ID NO: 740360 - protein, 130 aa, Homo sapiens
MSRELAPLLLLLLSIHSALAMRICSFNVRSFGESKQEDKNAMDVIVKVIKRCDIILVMEIKDSNNRICPILMEKLNRNQRRGITHNYAINSRFGRDTYQAQHTFFYKKNRHSRRKNTPTEPIGQRPRQAL

SEQ ID NO: 740361 - protein, 149 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASILDKHSWKQLGDHLNTALSSA

SEQ ID NO: 740362 - protein, 252 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKVMHHEHF

SEQ ID NO: 740363 - protein, 102 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEL

SEQ ID NO: 740364 - protein, 142 aa, Homo sapiens
TLRPLSPPDHGRRRRAVRGCVRAVRGDRKVSLHARERECGKMHFSDAPVFPHPLGACPLPSLLPLFPSRPSHPGVFIDVYLELLPGGGLGVLSGPLRPPSRGWPPRKAWGRLPAFYLTVAQGRGTADFIVASVGVIVTLHVP

SEQ ID NO: 740365 - protein, 929 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 740366 - protein, 831 aa, Homo sapiens
ERLFEGIIKGKYKMNPRQWSHISESAKDLVRRMLMLDPAERITVYEALDHPWLKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 740367 - protein, 334 aa, Homo sapiens
IHVPLWNRVRKPVWVLCDESVFYVSSPNTMCAYKTSVFLLNAGKFYYFFIGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 740368 - protein, 906 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 740369 - protein, 303 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKVHEHSQVTFYTLSEHFQ

SEQ ID NO: 740370 - protein, 128 aa, Homo sapiens
MNKNVKRERIQLISLFCLLFPPLMPTPTSISSPFRMNLFSVCRRSLTSYREHMHTTSISQLSTMKLMRQSDIWRKLLSSCAQPHSGSLSPGSIRPLPRYLSITGSTSFVEKPLCYRPCVSRSWSLETT

SEQ ID NO: 740371 - protein, 906 aa, Homo sapiens; identical to SEQ ID NO: 740368

SEQ ID NO: 740372 - protein, 929 aa, Homo sapiens; identical to SEQ ID NO: 740365

SEQ ID NO: 740373 - protein, 466 aa, Homo sapiens
MALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 740374 - protein, 917 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 740375 - protein, 740 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRTLITKHPDRFAYPIPRKQCLN

SEQ ID NO: 740376 - protein, 676 aa, Homo sapiens
RCGRYPLRTMADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQECYPMFPQKIVLNLECWS

SEQ ID NO: 740377 - protein, 126 aa, Homo sapiens
MGKQGTVSRLPMAVSRPPLWARSRVELLGHSTPHGKPRPWFSPGFCGRNPAPLKRQPESSEISRPPHTHRSPKPRLEIGQNLRKLPPQGLRAEISGPHSPPRRLTSLGPALITGGVGCEVLKVPLR

SEQ ID NO: 740378 - protein, 126 aa, Homo sapiens; identical to SEQ ID NO: 740377

SEQ ID NO: 740379 - protein, 102 aa, Homo sapiens
MESGRPLQSDQASQGPMHGPGHCPKDFVHSPSVLSQDNPTEAATVITSLVQKSMLTPRGFSYFRNHVASSPGLFALTLCCPYTKIKPWGCAVVVKTMGLPQP

SEQ ID NO: 740380 - protein, 115 aa, Homo sapiens
SDTGHSFCSDSGTEMQSNKCQDCGTKIPTSRRACRKEPTKEFHYRYNTPGQNYSNHSKRGAFVQPHSLDESKNSSPSLASPFCCPGLVHSPDTSKSSPTSGWQEAELGLENMKSQ

SEQ ID NO: 740381 - protein, 54 aa, Homo sapiens
DDDSYNSVDGMELTSQGAGTYWYLPPECFVVGKEPPKISNKVDVWSVGVIFYQC

SEQ ID NO: 740382 - protein, 313 aa, Homo sapiens
MDFDERGPCSSNMYLPSCTYYVSGPDFSSLPSFLPQTPSSRPMTYSYSSNLPQVQPVREVTFREYAIEPATKWHPRGNLAHCYSAEELVHRDCLQAPSAAGVPGDVLAKSSANVYHHPTPAVSSNFYSTVGRNGVLPQAFDQFFETAYGTPENLASSDYPGDKSAEKGPPAATATSAAAAAAATGAPATSSSDSGGGGGCRETAAAAEEKERRRRPESSSSPESSSGHTEDKAGGSSGQRTRKKRCPYTKYQIRELEREFFFSVYINKEKRLQLSRMLNLTDRQVKIWFQNRRMKEKKINRDRLQYYSANPLL

SEQ ID NO: 740383 - protein, 279 aa, Homo sapiens
KEAAAVENHVKLGYCGEPKVQPVREVTFREYAIEPATKWHPRGNLAHCYSAEELVHRDCLQAPSAAGVPGDVLAKSSANVYHHPTPAVSSNFYSTVGRNGVLPQAFDQFFETAYGTPENLASSDYPGDKSAEKGPPAATATSAAAAAAATGAPATSSSDSGGGGGCRETAAAAEEKERRRRPESSSSPESSSGHTEDKAGGSSGQRTRKKRCPYTKYQIRELEREFFFSVYINKEKRLQLSRMLNLTDRQVKIWFQNRRMKEKKINRDRLQYYSANPLL

SEQ ID NO: 740384 - protein, 313 aa, Homo sapiens; identical to SEQ ID NO: 740382

SEQ ID NO: 740385 - protein, 225 aa, Homo sapiens [sequence omitted]

SEQ ID NO: 740386 - protein, 225 aa, Homo sapiens [sequence omitted]

SEQ ID NO: 740387 - protein, 243 aa, Homo sapiens
GRVGRPTRRLRRCMCGNNMSTPLPAIVPAARKATAAVIFLHGLGDTGHGWAEAFAGIRSSHIKYICPHAPVRPVTLNMNVAMPSWFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 740388 - protein, 225 aa, Homo sapiens [sequence omitted]

SEQ ID NO: 740389 - protein, 187 aa, Homo sapiens
MDWEILGTDGQKPLQVSEVHISNISARMRFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 740390 - protein, 166 aa, Homo sapiens
MNVAMPSWFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 740391 - protein, 166 aa, Homo sapiens; identical to SEQ ID NO: 740390

SEQ ID NO: 740392 - protein, 97 aa, Homo sapiens
TLEFGHYGRALDLVGWSRRLQGPIGGANRDISILQCHGDCDPLVPLMFGSLTVEKLKTLVNPANVTFKTYEGMMHSSCQQEMMDVKQFIDKLLPPID

SEQ ID NO: 740393 - protein, 211 aa, Homo sapiens
MSTPLPAIVPAARKATAAVIFLHGLGDTGHGWAEAFAGIRSSHIKYICPHAPVRPVTLNMNVAMPSWFDIIGLSPDSQEDESGIKQAAENIKALIDQEVKNGIPSNRIILGGFSQGGALSLYTALTTQQKLAGVTALSCWLPLRASFPQCHGDCDPLVPLMFGSLTVEKLKTLVNPANVTFKTYEGMMHSSCQQEMMDVKQFIDKLLPPID

SEQ ID NO: 740394 - protein, 152 aa, Homo sapiens
KDFALFYRFDIIGLSPDSQEDESGIKQAAENIKALIDQEVKNGIPSNRIILGGFSQGGALSLYTALTTQQKLAGVTALSCWLPLRASFPQCHGDCDPLVPLMFGSLTVEKLKTLVNPANVTFKTYEGMMHSSCQQEMMDVKQFIDKLLPPID

SEQ ID NO: 740395 - protein, 225 aa, Homo sapiens [sequence omitted]

SEQ ID NO: 740396 - protein, 225 aa, Homo sapiens [sequence omitted]

SEQ ID NO: 740397 - protein, 189 aa, Homo sapiens
MSTPLPAIVPAARKATAAVIFLHGLGDTGHGWAEAFAGIRSSHIKYICPHAPVRPVTLNMNVAMPSWFDIIGLSPDSQEDESGIKQAAENIKALIDQEVKNGIPSNRIILGGFSQVSHTESDWWSSNPISTVPGENITAWDVKGSRVLMCCSNPWGMVRVMGLLDAGRSTASRMWDVVSWVGRYSEGVC

SEQ ID NO: 740398 - protein, 225 aa, Homo sapiens [sequence omitted]

SEQ ID NO: 740399 - protein, 181 aa, Homo sapiens
MGRSLCRPVRPVTLNMNVAMPSWFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 740400 - protein, 166 aa, Homo sapiens; identical to SEQ ID NO: 740390

SEQ ID NO: 740401 - protein, 191 aa, Homo sapiens
MSTPLPAIVPAARKATAAVIFLHGLGDTGHGWAEAFAGIRSSHIKYICPHAPVRPVTLNMNVAMPSWFDIIGLSPDSQEDESGIKQAAENIKALIDQEVKNGIPSNRIILGGFSQGPIGGANRDISILQCHGDCDPLVPLMFGSLTVEKLKTLVNPANVTFKTYEGMMHSSCQQEMMDVKQFIDKLLPPID

SEQ ID NO: 740402 - protein, 167 aa, Homo sapiens
GPEGHRCGDFPAWIGRYWARMGRSLCRPVRPVTLNMNVAMPSWFDIIGLSPDSQEDESGIKQAAENIKALIDQEVKNGIPSNRIILGGFSQGPIGGANRDISILQCHGDCDPLVPLMFGSLTVEKLKTLVNPANVTFKTYEGMMHSSCQQEMMDVKQFIDKLLPPID

SEQ ID NO: 740403 - protein, 127 aa, Homo sapiens
MDWEILVKALIDQEVKNGIPSNRIILGGFSQGGALSLYTALTTQQKLAGVTALSCWLPLRASFPQCHGDCDPLVPLMFGSLTVEKLKTLVNPANVTFKTYEGMMHSSCQQEMMDVKQFIDKLLPPID

SEQ ID NO: 740404 - protein, 502 aa, Homo sapiens
VSSRSHVTAVLTVFHGRCFLPGFGVVTTFPSPSPAGAMEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGVTCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 740405 - protein, 367 aa, Homo sapiens
DPQAVIRLKLNEWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGVTCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 740406 - protein, 228 aa, Homo sapiens
LIAILHEVNKEETGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 740407 - protein, 502 aa, Homo sapiens; identical to SEQ ID NO: 740404

SEQ ID NO: 740408 - protein, 117 aa, Homo sapiens
AAHMGVALRDLPGRHVSSRSHVTAVLTVFHGRCFLPGFGVVTTFPSPSPAGAMEEEDEEARALLAGGPDEADRGAPAAPGALPALCDPSRLAHRLLVLLLMCFLGFGEPAGWVGADL

SEQ ID NO: 740409 - protein, 115 aa, Homo sapiens
VSSRSHVTAVLTVFHGRCFLPGFGVVTTFPSPSPAGAMEEEDEEARALLAGGPDEADRGAPAAPGALPALCDPSRLAHRLLVLLLMCFLGFGSYFCYDNPAALQTQVKRMGHNHF

SEQ ID NO: 740410 - protein, 465 aa, Homo sapiens
MEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGVTCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 740411 - protein, 392 aa, Homo sapiens [sequence omitted]

SEQ ID NO: 740412 - protein, 368 aa, Homo sapiens
MIILLPFRLKLNEWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGVTCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 740413 - protein, 502 aa, Homo sapiens; identical to SEQ ID NO: 740404

SEQ ID NO: 740414 - protein, 375 aa, Homo sapiens
VSSRSHVTAVLTVFHGRCFLPGFGVVTTFPSPSPAGAMEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGVTCILSLICALALAYLDQRAERILHKEQGKTGEVIKLTDVKDFSLPLWLIFIICVCYYVAVFPFIGLGKSFSLPRTLDFLPTAQVPFTVLVCLSVPFPVLGPVLSRAKPLWVCRTSCSR

SEQ ID NO: 740415 - protein, 115 aa, Homo sapiens
PYKPPRVTQGPSTVTSGEKRNAVLCAMLEVNEENVSWGLLTNCSPHPNPPDGQGCVRGSGHKAPLAGQQLAHETALSAPPLNGSSMGSSEEHRRLLCVTSPLISRAAEIHYRTQN

SEQ ID NO: 740416 - protein, 81 aa, Homo sapiens
GGVCPGPLPVRSAAPDSSGSLKRDQRRPHLGTSTHRPLLLQRQQPSAPSLAPCSEAQELASPRRLNQPNFRDSSRLRGRFI

SEQ ID NO: 740417 - protein, 176 aa, Homo sapiens
MDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740418 - protein, 638 aa, Homo sapiens
DRAPSSVPAPRESAQFPRRGPCSLRRAPSAGRARITEVVRGGPKPPGRGGARASGGAAGPAPAMPPGKVLQPVLKMKVDELFLYWLSEASTQRMLQDCLRRIKAPGRDQPTPGDGEQPGAWPTARSLPPAQRARTPREPPGRALTLPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740419 - protein, 544 aa, Homo sapiens
RRRGEQRREQPGLHSRGSGERGARPGPRRALRAGGMRLRERSLRQDPDLRQELASLARGCDFVLPSRFKKRLKAFQQVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740420 - protein, 482 aa, Homo sapiens
YQLGPYSAEIRRTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740421 - protein, 395 aa, Homo sapiens
GVAAPPSHLSWARVAPGRPRPDPPRFPRPGAAPPAGPFPLPPPVPWRPRAAETKGAPLSRLPVSVRGEAPGGLCAPTALTAPPQVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740422 - protein, 446 aa, Homo sapiens
QLVTSKTFTVHRSAGWKISVWQSGAWFIDGAFPLRPHGVEGACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740423 - protein, 453 aa, Homo sapiens
DARTGRAERAVSFCSRGSLGGVGQARGTQQERRRPGPADCPLLPSLPQACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740424 - protein, 740 aa, Homo sapiens
TAPPPRSPRPASPRSSRGAGPVPCAAPPQRAVLASPRSVRGGPKPPGRGGARASGGAAGPAPAMPPGKVLQPVLKMKVDELFLYWLSEASTQRMLQDCLRRIKAPGRDQPTPGDGEQPGAWPTARSLPPAQRARTPREPPGRALTLPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHGLFLRLKAVPLRPEYSALYKSVLEPRSALRSVDFMLDLALLDGKAWWAPRMGRAGASGPRGSPRPRRPLSFSVPTASSLGSGGWCRRGRGTVRAAHQPHSFPALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740425 - protein, 135 aa, Homo sapiens
MLFYFFETESHFVAQCGERRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 740426 - protein, 680 aa, Homo sapiens
TAPPPRSPRPASPRSSRGAGPVPCAAPPQRAVLASPRSVRGGPKPPGRGGARASGGAAGPAPAMPPGKVLQPVLKMKVDELFLYWLSEASTQRMLQDCLRRIKAPGRDQPTPGDGEQPGAWPTARSLPPAQRARTPREPPGRALTLPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHGLFLRLKAVPLRPEYSALYKSVLEPRSALRSVDFMLDLALLDGKAWWAPRMGRAGASGPRGSPRPRRPLSFSVPTASSLGSGGWCRRGRGTVRAAHQPHSFPALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYACGDEDLEPL

SEQ ID NO: 740427 - protein, 348 aa, Homo sapiens
DRAPSSVPAPRESAQFPRRGPCSLRRAPSAGRARITEVVRGGPKPPGRGGARASGGAAGPAPAMPPGKVLQPVLKMKVDELFLYWLSEASTQRMLQDCLRRIKAPGRDQPTPGDGEQPGAWPTARSLPPAQRARTPREPPGRALTLPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVGPQRRGRRFQRGARVFLQQP

SEQ ID NO: 740428 - protein, 497 aa, Homo sapiens
DRAPSSVPAPRESAQFPRRGPCSLRRAPSAGRARITEVVRGGPKPPGRGGARASGGAAGPAPAMPPGKVLQPVLKMKVDELFLYWLSEASTQRMLQDCLRRIKAPGRDQPTPGDGEQPGAWPTARSLPPAQRARTPREPPGRALTLPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQQQGRISMPMVGSTLEEKKNTASLSNGPGVDRRGRALASSSRVFYKEGGRCHKDGGAPTGARKVPGTR

SEQ ID NO: 740429 - protein, 166 aa, Homo sapiens
RPPPPPAPCALLSLRNARGAGPGPRAPGGRRMERAEPGPRLQRPAGPGPALPRERGARPGPRRALRAGGMRLRERSLRQDPDLRQELASLARGCDFVLPSRFKKRLKAFQQVSPARPAAARHRARPPGPASPALPAPRGPPLAAAGRAPVVAWRGPNARFTGPVVG

SEQ ID NO: 740430 - protein, 110 aa, Homo sapiens
MGASGSKARGLWPFASAAGGGGSEAAGAEQALVRPRGRAVPPFVFTRRGSMFYDEDGDLAHEFYEETIVTKNGQKRAKLRRVHKNLIPQGIVKLDHPRIHVDFPVILYEV

SEQ ID NO: 740431 - protein, 110 aa, Homo sapiens; identical to SEQ ID NO: 740430

SEQ ID NO: 740432 - protein, 110 aa, Homo sapiens; identical to SEQ ID NO: 740430

SEQ ID NO: 740433 - protein, 110 aa, Homo sapiens; identical to SEQ ID NO: 740430

SEQ ID NO: 740434 - protein, 171 aa, Homo sapiens
MGASGSKARGLWPFASAAGGGGSEAAGAEQALVRPRGRAVPPFVFTRRGLLLFQSLTLGQQHLLECDQHAQATTLPTLEVLGERQSPDIRMAALAEQIKDENWPWWLPGCSMFYDEDGDLAHEFYEETIVTKNGQKRAKLRRVHKNLIPQGIVKLDHPRIHVDFPVILYEV

SEQ ID NO: 740435 - protein, 894 aa, Homo sapiens
LGTPVIVLADGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTHFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLVGQGASDLTNTASDFSSDIRLSSELSGSINDLNTLDPNLLFDPGRQQGQDDEATLEELKNDPLFQQICSESMNSMTSSGFEWIESKDHPTVEMLG

SEQ ID NO: 740436 - protein, 876 aa, Homo sapiens
LGTPVIVLADGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDISGHGILPSYQELVEDRFRKPHAFAVPGQSYQSQSRHHDTHFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLVGQGASDLTNTASDFSSDIRLSSELSGSINDLNTLDPNLLFDPGRQQGQDDEATLEELKNDPLFQQICSESMNSMTSSGFEWIESKDHPTVEMLG

SEQ ID NO: 740437 - protein, 789 aa, Homo sapiens
LGTPVIVLADGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDISGHGILPSYQELVEDRFRKPHAFAVPGQSYQSQSRHHDTHFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLKYPDVLGE

SEQ ID NO: 740438 - protein, 794 aa, Homo sapiens
LGTPVIVLADGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDISGHGILPSYQELVEDRFRKPHAFAVPGQSYQSQSRHHDTHFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLCSCPSSLLAGMQM

SEQ ID NO: 740439 - protein, 789 aa, Homo sapiens; identical to SEQ ID NO: 740437

SEQ ID NO: 740440 - protein, 571 aa, Homo sapiens
LGTPVIVLADGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPTRAPDAVYTELQPTSPDPNLACCCNTTTPDPDPSNWKVRMACSDTCIQTGILW

SEQ ID NO: 740441 - protein, 223 aa, Homo sapiens
KTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLT

SEQ ID NO: 740442 - protein, 78 aa, Homo sapiens
LGGLVAPRRCARPTGPLNQKRDVWQGALESFHFGLVISCRLFLVFVTAHSEHFSSAVYTMSGISNMFLEVVSAVLYEA

SEQ ID NO: 740443 - protein, 401 aa, Homo sapiens
MEPRRAAPGVPGWGSREAAGSASAAELVYHLAGALGTELQDLARRFGPEAAAGLVPLVVRALELLEQAAVGPAPDSLQVSAQPAEQELRRLREENERLRRELRAGPQEERALLRQLKEVTDRQRDELRAHNRDLRQRGQETEALQEQLQRLLLVNAELRHKLAAMQTQLRAAQDRERERQQPGEAATPQAKERARGQAGRPGHQHGQEPEWATAGAGAPGNPEDPAEAAQQLGRPSEAGQCRFSREEFEQILQERNELKAKVFLLKEELAYFQRELLTDHRVPGLLLEAMKVAVRKQRKKIKAKMLGTPEEAESSEDEAGPWILLSDDKGDHPPPPESKIQSFFGLWYRGKAESSEDETSSPAPSKLGGEEEAQPQSPAPDPPCSALHEHLCLGASAAPEA

SEQ ID NO: 740444 - protein, 133 aa, Homo sapiens
EGSTQVTTCSPEPQLLDPPGWKLAVLFPVTLGVERTEPRRPRALSPYPTPSPFLVPPYPYRFYPAHTALNGFLGRNCFAFPRPSGGWGGGVAALSLWETWSPGGRRPGCLAGGLGRPRGRHRPRSLSSLWGQI

SEQ ID NO: 740445 - protein, 373 aa, Homo sapiens
MEPRRAAPGVPGWGSREAAGSASAAELVYHLAGALGTELQDLARRFGPEAAAGLVPLVVRALELLEQAAVGPAPDSLQVSAQPAEQELRRLREENERLRRELRAGPQEERALLRQLKEVTDRQRDELRAHNRDLRQRGQETEALQEQLQRLLLVNAELRHKLAAMQTQLRAAQDRERERQQPGEAATPQAKERARGQAGRPGHQHGQEPEWATAGAGAPGNPEDPAEAAQQLGRPSEAGQCRFSREEFEQILQERNELKAKVFLLKEELAYFQRELLTDHRVPGLLLEAMKVAVRKQRKKIKAKMLGTPEEAESSFGLWYRGKAESSEDETSSPAPSKLGGEEEAQPQSPAPDPPCSALHEHLCLGASAAPEA

SEQ ID NO: 740446 - protein, 398 aa, Homo sapiens
MEPRRAAPGVPGWGSREAAGSASAAELVYHLAGALGTELQDLARRFGPEAAAGLVPLVVRALELLEQAAVGPAPDSLQVSAQPAEQELRRLREENERLRRELRAGPQEERALLRQLKEVTDRQRDELRAHNRDLRQRGQETEALQEQLQRLLLVNAELRHKLAAMQTQLRAAQDRERERQQPGEAATPQAKERARGQAGRPGHQHGQEPEWATAGAGAPGNPEDPAEAAQQLGRPSEAGQCRFSREEFEQILQERNELKAKVFLLKEELAYFQRELLTDHRVPGLLLEAMKVAVRKQRKKIKAKMLGTPEEAESSEDEAGPWILLSDDKGDHPPPPESKIQSFFGLWYRGKAESSEDETSSPAPSKLGGEEEAQPQSPAPDPPCSALHEHLSSLWGQI

SEQ ID NO: 740447 - protein, 228 aa, Homo sapiens
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREVSKLVSMNPVEKEHTSQNNEGTPTQKTARLFSKKWASSF

SEQ ID NO: 740448 - protein, 228 aa, Homo sapiens; identical to SEQ ID NO: 740447

SEQ ID NO: 740449 - protein, 114 aa, Homo sapiens
TTKIAAASTVYIRCYVKVLQRPLKKVNGDSGLLPTTGSSSRTSLIVSVLYNLSFEQRVLRLKTEDYGWAQWLMPTDRGGWIMMRSGVRDQPGQHGEAPSLLGIQKLAERGGRCL

SEQ ID NO: 740450 - protein, 1204 aa, Homo sapiens
MKDQQTVIMTECTSLQFVSPFAFEAMQKVDVVCLASLSDPELRLLLPCLVRMALCAPADQSQSWAQDKKLILRLLSGVEAVNSIVALLSVDFHALEQDASKEQQLRHKLGGGSGESILVSQLQHGLTLEFEHSDSPRRLRLVLSELLAIMNKVSESNGEFFFKSSELFESPVYLEEAADVLCILQAELPSLLPIVDVAEALLHVRNGAWFLCLLVANVPDSFNEVCRGLIKNGERQDEESLGGRRRTDALRFLCKMNPSQALKVRGMVVEECHLPGLGVALTLDHTKNEACEDGVSDLVCFVSGLLLGTNAKVRTWFGTFIRNGQQRKRETSSSVLWQMRRQLLLELMGILPTVRSTRIVEEADVDMEPNVSVYSGLKEEHVVKASALLRLYCALMGIAGLKPTEEEAEQLLQLMTSRPPATPAGVRFVSLSFCMLLAFSTLVSTPEQEQLMVVWLSWMIKEEAYFESTSGVSASFGEMLLLVAMYFHSNQLSAIIDLVCSTLGMKIVIKPSSLSRMKTIFTQEIFTEQVVTAHAVRVPVTSNLSANITGFLPIHCIYQLLRSRSFTKHKVSIKDWIYRQLCETSTPLHPQLLPLIDVYINSILTPASKSNPEATNQPVTEQEILNIFQGVIGGDNIRLNQRFSITAQLLVLYYILSYEEALLANTKTLAAMQRKPKSYSSSLMDQIPIKFLIRQAQGLQQELGGLHSALLRLLATNYPHLCIVDDWICEEEITGTDALLRRMLLTNNAKNHSPKQLQEAFSAVPVNHTQVMQIIEHLTLLSASELIPYAEVLTSNMSQLLNSGVPRRILQTVNKLWMVLNTVMPRRLWVMTVNALQPSIKFVRQQKYTQNDLMIDPLIVLRCDQRVHRCPPLMDITLHMLNGYLLASKAYLSAHLKETEQDRPSQNNTIGLVGQTDAPEVTREELKNALLAAQDSAAVQILLEICLPTEEEKANGVNPDSLLRNVQSVITTSAPNKGMEEGEDNLLCNLREVQCLICCLLHQMYIADPNIAKLVHFQGYPCELLPLTVAGIPSMHICLDFIPELIAQPELEKQIFAIQLLSHLCIQYALPKSLSVARLAVNVMGTLLTVLTQAKRYAFFMPTLPSLVSFCRAFPPLYEDIMSLLIQIGQVCASDVATQTRDIDPIITRLQQIKEKPSGWSQICKDSSYKNGSRDTGSMDPDVQLCHCIERTVIEIINMSVSGI

SEQ ID NO: 740451 - protein, 1196 aa, Homo sapiens
MTECTSLQFVSPFAFEAMQKVDVVCLASLSDPELRLLLPCLVRMALCAPADQSQSWAQDKKLILRLLSGVEAVNSIVALLSVDFHALEQDASKEQQLRHKLGGGSGESILVSQLQHGLTLEFEHSDSPRRLRLVLSELLAIMNKVSESNGEFFFKSSELFESPVYLEEAADVLCILQAELPSLLPIVDVAEALLHVRNGAWFLCLLVANVPDSFNEVCRGLIKNGERQDEESLGGRRRTDALRFLCKMNPSQALKVRGMVVEECHLPGLGVALTLDHTKNEACEDGVSDLVCFVSGLLLGTNAKVRTWFGTFIRNGQQRKRETSSSVLWQMRRQLLLELMGILPTVRSTRIVEEADVDMEPNVSVYSGLKEEHVVKASALLRLYCALMGIAGLKPTEEEAEQLLQLMTSRPPATPAGVRFVSLSFCMLLAFSTLVSTPEQEQLMVVWLSWMIKEEAYFESTSGVSASFGEMLLLVAMYFHSNQLSAIIDLVCSTLGMKIVIKPSSLSRMKTIFTQEIFTEQVVTAHAVRVPVTSNLSANITGFLPIHCIYQLLRSRSFTKHKVSIKDWIYRQLCETSTPLHPQLLPLIDVYINSILTPASKSNPEATNQPVTEQEILNIFQGVIGGDNIRLNQRFSITAQLLVLYYILSYEEALLANTKTLAAMQRKPKSYSSSLMDQIPIKFLIRQAQGLQQELGGLHSALLRLLATNYPHLCIVDDWICEEEITGTDALLRRMLLTNNAKNHSPKQLQEAFSAVPVNHTQVMQIIEHLTLLSASELIPYAEVLTSNMSQLLNSGVPRRILQTVNKLWMVLNTVMPRRLWVMTVNALQPSIKFVRQQKYTQNDLMIDPLIVLRCDQRVHRCPPLMDITLHMLNGYLLASKAYLSAHLKETEQDRPSQNNTIGLVGQTDAPEVTREELKNALLAAQDSAAVQILLEICLPTEEEKANGVNPDSLLRNVQSVITTSAPNKGMEEGEDNLLCNLREVQCLICCLLHQMYIADPNIAKLVHFQGYPCELLPLTVAGIPSMHICLDFIPELIAQPELEKQIFAIQLLSHLCIQYALPKSLSVARLAVNVMGTLLTVLTQAKRYAFFMPTLPSLVSFCRAFPPLYEDIMSLLIQIGQVCASDVATQTRDIDPIITRLQQIKEKPSGWSQICKDSSYKNGSRDTGSMDPDVQLCHCIERTVIEIINMSVSGI

SEQ ID NO: 740452 - protein, 1196 aa, Homo sapiens; identical to SEQ ID NO: 740451

SEQ ID NO: 740453 - protein, 533 aa, Homo sapiens
MQRKPKSYSSSLMDQIPIKFLIRQAQGLQQELGGLHSALLRLLATNYPHLCIVDDWICEEEITGTDALLRRMLLTNNAKNHSPKQLQEAFSAVPVNHTQVMQIIEHLTLLSASELIPYAEVLTSNMSQLLNSGVPRRILQTVNKLWMVLNTVMPRRLWVMTVNALQPSIKFVRQQKYTQNDLMIDPLIVLRCDQRVHRCPPLMDITLHMLNGYLLASKAYLSAHLKETEQDRPSQNNTIGLVGQTDAPEVTREELKNALLAAQDSAAVQILLEICLPTEEEKANGVNPDSLLRNVQSVITTSAPNKGMEEGEDNLLCNLREVQCLICCLLHQMYIADPNIAKLVHFQGYPCELLPLTVAGIPSMHICLDFIPELIAQPELEKQIFAIQLLSHLCIQYALPKSLSVARLAVNVMGTLLTVLTQAKRYAFFMPTLPSLVSFCRAFPPLYEDIMSLLIQIGQVCASDVATQTRDIDPIITRLQQIKEKPSGWSQICKDSSYKNGSRDTGSMDPDVQLCHCIERTVIEIINMSVSGI

SEQ ID NO: 740454 - protein, 161 aa, Homo sapiens
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFENYIKTISTTISPLLLIP

SEQ ID NO: 740455 - protein, 161 aa, Homo sapiens; identical to SEQ ID NO: 740454

SEQ ID NO: 740456 - protein, 149 aa, Homo sapiens
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFEPNLFW

SEQ ID NO: 740457 - protein, 161 aa, Homo sapiens; identical to SEQ ID NO: 740454

SEQ ID NO: 740458 - protein, 155 aa, Homo sapiens
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFELSAEYGVGVLI

SEQ ID NO: 740459 - protein, 133 aa, Homo sapiens
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRPPLATYLGNASYSSCSSCPLLAYSTITSSSFSEVTLKTT

SEQ ID NO: 740460 - protein, 207 aa, Homo sapiens
MQPSGWAAAREAAGRDMLAADLRCSLFASALQSYKRDSVLRPFPASYARGDCKDFEALTSLFGEGTYLTSDLSLALIYSPHGHGWQHSLLGPILSCVAVCEVIDHPDVKCQTKKKDSKEIDRRRARIKHSEGGDIPPKYFVVTNNQLLRVKYLLVYSQKPPKRASSQLSWFSSHWFTVMISLYLLLLLIVSVINSSAFQHFWNRAKR

SEQ ID NO: 740461 - protein, 322 aa, Homo sapiens
MQPSGWAAAREAAGRDMLAADLRCSLFASALQSYKRDSVLRPFPASYARGDCKDFEALLADASKLPNLKELLQSSGDNHKRAWDLVSWILSSKVLTIHSAGKAEFEKIQKLTGAPHTPVPAPDFLFEIEYFDPANAKFYETKGERDLIYAFHGSRLENFHSIIHNGLHCHLNKTSLFGEGTYLTSDLSLALIYSPHGHGWQHSLLGPILSCVAVCEVIDHPDVKCQTKKKDSKEIDRRRARIKHSEGGDIPPKYFVVTNNQLLRVKYLLVYSQKPPKRASSQLSWFSSHWFTVMISLYLLLLLIVSVINSSAFQHFWNRAKR

SEQ ID NO: 740462 - protein, 322 aa, Homo sapiens; identical to SEQ ID NO: 740461

SEQ ID NO: 740463 - protein, 322 aa, Homo sapiens; identical to SEQ ID NO: 740461

SEQ ID NO: 740464 - protein, 310 aa, Homo sapiens
MQPSGWAAAREAAGRDMLAADLRCSLFASALQSYKRDSVLRPFPASYARGDCKDFEALLADASKLPNLKELLQSSGDNHKRAWDLVSWILSSKVLTIHSAGKAEFEKIQKLTGAPHTPVPAPDFLFEIEYFDPANAKFYETKGERDLIYAFHGSRLENFHSIIHNGLHCHLNKTSLFGEGTYLTSDLSLALIYSPHGHGWQHSLLGPILSCVAVCEVIDHPDVKCQTKKKDSKEIDRRRARIKHSEGGDIPPKYFVVTNNQLLRVKYLLVYSQKPPKRASSQLSWFSSHWFTVMISLYLLLLLIDPPAML

SEQ ID NO: 740465 - protein, 103 aa, Homo sapiens
AAREAAGRDMLAADLRCSLFASALQSYKRDSVLRPFPASYARGDCKDFEALVSVLCPGAAHCVLDQVPCGTTGRGSSIRISKHDSRQTFHSQLGLALPWGRFP

SEQ ID NO: 740466 - protein, 938 aa, Homo sapiens
MAEKRPLRTLGPVMYGKLPRLETDSGLEHSLPHSVGNQDPCTYKGSYFSCPMAGTPKAESEQLASWTPYPPLYSTGMAGPPLQADNLLTNCLFYRSPAEGPEKMQDSSPVELLPFSPQAHSYPGPPLAAPKPVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASRYTGPYPRNSKQAMSEGPSSPWTQLAQPLGPPCQDTGPTHYPPPHHPPPHPPQALPCPPACRHPEKQGSYSPALPLQPLGGHKGTGYQAGGLGSPYLRQQAAQAPYIPPLGLDAYPYPSAPLPAPSPGLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEDARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGEHGAAPVATGAV

SEQ ID NO: 740467 - protein, 938 aa, Homo sapiens; identical to SEQ ID NO: 740466

SEQ ID NO: 740468 - protein, 815 aa, Homo sapiens
MAEKRPLRTLGPVMYGKLPRLETDSGLEHSLPHSVGNQDPCTYKGSYFSCPMAGTPKAESEQLASWTPYPPLYSTGMAGPPLQADNLLTNCLFYRSPAEGPEKMQDSSPVELLPFSPQAHSYPGPPLAAPKPVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASSTLSSLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEDARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGEHGAAPVATGAV

SEQ ID NO: 740469 - protein, 749 aa, Homo sapiens
MAEKRPLRTLGPVMYGKLPRLETDSGLEHSLPHSVGNQDPCTYKGSYFSCPMAGTPKAESEQLASWTPYPPLYSTGMAGPPLQADNLLTNCLFYRSPAEGPEKMQDSSPVELLPFSPQAHSYPGPPLAAPKPVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASRYTGPYPRNSKQAMSEGPSSPWTQLAQPLGPPCQDTGPTHYPPPHHPPPHPPQALPCPPACRHPEKQGSYSPALPLQPLGGHKGTGYQAGGLGSPYLRQQAAQAPYIPPLGLDAYPYPSAPLPAPSPGLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEDARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTRLRGRTARVCRGCWPSCCLSCSASIAPTGAPSPMWCELAPSSCPFTW

SEQ ID NO: 740470 - protein, 1047 aa, Homo sapiens
MAEKRPLRTLGPVMYGKLPRLETDSGLEHSLPHSVGNQDPCTYKGSYFSCPMAGTPKAESEQLASWTPYPPLYSTGMAGPPLQADNLLTNCLFYRSPAEGPEKMQDSSPVELLPFSPQAHSYPGPPLAAPKPVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASRYTGPYPRNSKQAMSEGPSSPWTQLAQPLGPPCQDTGPTHYPPPHHPPPHPPQALPCPPACRHPEKQGSYSPALPLQPLGGHKGTGYQAGGLGSPYLRQQAAQAPYIPPLGLDAYPYPSAPLPAPSPGLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEDARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGDFDTEAGAVSSSEPTVARDEPESLALAQKSPAPKVRKPGRKPPTPGPEKAEAAAGEESCGASPTPATSASPPGPTLKARFRSLLETAWLNGLALPTWGHKSSRPDQPSPCPQLLDSQSHHL

SEQ ID NO: 740471 - protein, 145 aa, Homo sapiens
PAVTAPELQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGEHGAAPVATGAV

SEQ ID NO: 740472 - protein, 938 aa, Homo sapiens; identical to SEQ ID NO: 740466

SEQ ID NO: 740473 - protein, 938 aa, Homo sapiens; identical to SEQ ID NO: 740466

SEQ ID NO: 740474 - protein, 938 aa, Homo sapiens; identical to SEQ ID NO: 740466

SEQ ID NO: 740475 - protein, 648 aa, Homo sapiens
MAEKRPLRTLGPVMYGKLPRLETDSGLEHSLPHSVGNQDPCTYKGSYFSCPMAGTPKAESEQLASWTPYPPLYSTGMAGPPLQADNLLTNCLFYRSPAEGPEKMQDSSPVELLPFSPQAHSYPGPPLAAPKPVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASRYTGPYPRNSKQAMSEGPSSPWTQLAQPLGPPCQDTGPTHYPPPHHPPPHPPQALPCPPACRHPEKQGSYSPALPLQPLGGHKGTGYQAGGLGSPYLRQQAAQAPYIPPLGLDAYPYPSAPLPAPSPGLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEDARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSLPF

SEQ ID NO: 740476 - protein, 119 aa, Homo sapiens
ASCRGLLNLGKSVSVNVCKCACEREHPFPTSRNKIPFGALSLCVPREASSQEPSVGIVSFVTLPIPSQFLIDSCRLLGSRIWVGYGMLFQCLASVFIHPPAQHCQPRAYSADTTYCSSS

SEQ ID NO: 740477 - protein, 119 aa, Homo sapiens; identical to SEQ ID NO: 740476

SEQ ID NO: 740478 - protein, 441 aa, Homo sapiens
MALQVRFWGFLLFLFLVSDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 740479 - protein, 327 aa, Homo sapiens
MCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 740480 - protein, 522 aa, Homo sapiens
PLPTLLCGGRTGHRTARVLSFLIRSCPCEPGKGCVYGKPVTLWPTISSVVPSTFLGLGNYEVEVEAEPDVRGPEIVTMGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLSDLH

SEQ ID NO: 740481 - protein, 531 aa, Homo sapiens
PLPTLLCGGRTGHRTARVLSFLIRSCPCEPGKGCVYGKPVTLWPTISSVVPSTFLGLGNYEVEVEAEPDVRGPEIVTMGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 740482 - protein, 421 aa, Homo sapiens
PLPTLLCGGRTGHRTARVLSFLIRSCPCEPGKGCVYGKPVTLWPTISSVVPSTFLGLGNYEVEVEAEPDVRGPEIVTMGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNGTSGSLCGSAALPLFQEDLQLLIEAFL

SEQ ID NO: 740483 - protein, 178 aa, Homo sapiens
MCGSSTPTHVHTWVCMSCWWLTRDPACVSCWWLTRDPACVSCWWLTRDPACVSSGWLTRDPACVSCWWLTRDPACVSCGWLTRDPACVSCGWLTRDPACVSCGWLTRDPACVSCWWLTRDLACVSCGWVTCDPTSMSCSRAHRLPVHRPLPAHLAESCLDALASPASVRFASLLGFHF

SEQ ID NO: 740484 - protein, 290 aa, Homo sapiens
PHTNNCTYFLTGLDAYNMPAWIFVNRSLALGKIRCFGFDMDYTLAAYKSPAYEALTFELLLERLVCIGYPHEILRYTYDPTFPTRRLVFDELYGNLLKVDAHGNVLLGAYGFTFLSEAEIWSFYPSKFIQRDDLQCFYILNMLFNLPETYLYACLVDFFSGCSRYTNCDTGYQHGNLFMSFRSLFQDVTDAMNNIHQSGCLKKTLEDLEKYVKKDPRLPILLGKMKEVGKVFLATNSSYNYTNAIMTYLFSISEAEASGRPWRSYFDLIVVDTQKPHFFAEGLVLRQVNT

SEQ ID NO: 740485 - protein, 251 aa, Homo sapiens
MDYTLAAYKSPAYEALTFELLLERLVCIGYPHEILRYTYDPTFPTRRLVFDELYGNLLKVDAHGNVLLGAYGFTFLSEAEIWSFYPSKFIQRDDLQCFYILNMLFNLPETYLYACLVDFFSGCSRYTNCDTGYQHGNLFMSFRSLFQDVTDAMNNIHQSGCLKKTLEDLEKYVKKDPRLPILLGKMKEVGKVFLATNSSYNYTNAIMTYLFSISEAEASGRPWRSYFDLIVVDTQKPHFFAEGLVLRQVNT

SEQ ID NO: 740486 - protein, 118 aa, Homo sapiens
MIACSHVLTPSLGLFRPAIGERPESPSTAASQEVPGPHQTSTQAAPGAAEEGGPTRTEIIILATRTQNVLGEKGRRVGELTAAVEKRFGFPEGSVELYADKVAARGLCHCPGRVSALQ

SEQ ID NO: 740487 - protein, 144 aa, Homo sapiens
RQLQQASIRPGAAAHTCNPSNLGGQGRRIACAVAHTYNPSTLGGQGRRIACAVAHTCNPSTLGGQGKRIACAAARTCNPSTLGGQGRRIARGQEFQTSLGNIARPPPLQKILKISQRWGCTPVVPATQEAEAGGSLEPRYLRLQ

SEQ ID NO: 740488 - protein, 164 aa, Homo sapiens
MGDLPGLVRLSIALRIQPNDGPVFYKVDGQRFGQNRTIKLLTGSSYKVEVKIKPSTLQVENISIGGVLVPLELKSKEPDGDRVVYTGTYDTEGVTPTKSGERQPIQITMPFTDIGTFETVWQVKFYNYHKRDHCQWGSPFSVIEYECKPNETRSLMWVNKESFL

SEQ ID NO: 740489 - protein, 135 aa, Homo sapiens
MTARSFTRWTGSASARTAPSSCSPAPPTRLRNISIGGVLVPLELKSKEPDGDRVVYTGTYDTEGVTPTKSGERQPIQITMPFTDIGTFETVWQVKFYNYHKRDHCQWGSPFSVIEYECKPNETRSLMWVNKESFL

SEQ ID NO: 740490 - protein, 128 aa, Homo sapiens
MGDLPGLVRLSIALRIQPNDGPVFYKVDGQRFGQNRTIKLLTGSSYKVEVKIKPSTLQVENISIGGVLVPLELKSKEPDGDRVVYTGTYDTEGVTPTKSGERQPIQITMPECLEQRPQEISLTYECEE

SEQ ID NO: 740491 - protein, 1012 aa, Homo sapiens
MLLKSIFIVYIFFYSISELSLDSTLHAVNLHCNNISKIEAIDHIWNLQHLDLSSNQISRIEGLNTLTKLCTLNLSCNLITKVEGLEELINLTRLNVSYNHIDDLSGLIPLHGIKHKLRYIDLHSNRIDSIHHLLQCMVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHNERKEKLKQQLKGKEVELEEIRKAYSTLNRKWHDKGELLCHLETQVKEVKEKFENKEKKLKAERDKSIELQKNAMEKLHSMDDAFKRQVDAIVEAHQAEIAQLANEKQKCIDSANLKVHQIEKEMRELLEETCKNKKTMEAKIKQLAFALNEIQQDM

SEQ ID NO: 740492 - protein, 159 aa, Homo sapiens
MICFQGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKKPSGQFLAL

SEQ ID NO: 740493 - protein, 96 aa, Homo sapiens
SFKGIIHYYEVNAMEKLHSMDDAFKRQVDAIVEAHQAEIAQLANEKQKCIDSANLKVHQIEKEMRELLEETCKNKKTMEAKIKQLAFALNEIQQDM

SEQ ID NO: 740494 - protein, 856 aa, Homo sapiens [sequence omitted]

SEQ ID NO: 740495 - protein, 1027 aa, Homo sapiens
TVGTRIPVLRHRQGGKVPGCRLEGGSSPRPAPSGRPSALPGGLSQAHGPLAGCRLRPRSPSPVLWRRRRRWWRQRRKWKTKTATAAAGMYASWTKACRGLEELINLTRLNVSYNHIDDLSGLIPLHGIKHKLRYIDLHSNRIDSIHHLLQCMVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHNERKEKLKQQLKGKEVELEEIRKAYSTLNRKWHDKGELLCHLETQVKEVKEKFENKEKKLKAERDKSIELQKNAMEKLHSMDDAFKRQVDAIVEAHQAEIAQLANEKQKCIDSANLKVHQIEKEMRELLEETCKNKKTMEAKIKQLAFALNEIQQDM

SEQ ID NO: 740496 - protein, 1095 aa, Homo sapiens
SWDEDSSFASPSRRESSRLSVGGWVLAPPRPLGPPFRASGRLVPSSRTPRWVPVKTPLPVASAMEAAAAVVAAEAEVENEDGDSSCGDVCFMDKGLQSISELSLDSTLHAVNLHCNNISKIEAIDHIWNLQHLDLSSNQISRIEGLNTLTKLCTLNLSCNLITKVEGLEELINLTRLNVSYNHIDDLSGLIPLHGIKHKLRYIDLHSNRIDSIHHLLQCMVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHNERKEKLKQQLKGKEVELEEIRKAYSTLNRKWHDKGELLCHLETQVKEVKEKFENKEKKLKAERDKSIELQKNAMEKLHSMDDAFKRQVDAIVEAHQAEIAQLANEKQKCIDSANLKVHQIEKEMRELLEETCKNKKTMEAKIKQLAFALNEIQQDM

SEQ ID NO: 740497 - protein, 270 aa, Homo sapiens
GNFLSLGDKELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHNERKEKLKQQLKGKEVELEEIRKAYSTLNRKWHDKGELLCHLETQVKEVKEKFENKEKKLKAERDKSIELQKNAMEKLHSMDDAFKRQVDAIVEAHQAEIAQLANEKQKCIDSANLKVHQIEKEMRELLEETCKNKKTMEAKIKQLAFALNEIQQDM

SEQ ID NO: 740498 - protein, 681 aa, Homo sapiens
MICFQGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDVQKKMTLQDSKRSKKKKKKFGGGRKF

SEQ ID NO: 740499 - protein, 215 aa, Homo sapiens
MICFQGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVRWFHFTITTYKRVVVFI

SEQ ID NO: 740500 - protein, 141 aa, Homo sapiens
EPCHRLIRGVLQQIPTERYGIDCIMNDEWMQGVPYPTPLEPFQLDPKHLSETSTLKEEENEVKSTLEHLGITEEHIRNNQGRDARSSITGVYRIILHRVQRKKALESVPVMMLPDPKERDLKKGSRVYRGIRHTSKFCSIL

SEQ ID NO: 740501 - protein, 69 aa, Homo sapiens
LDVGGGGGWLAAGVAERAGRLSLFGPTFLPAPALVHRLFIYLDLARINPQLPASAESPGGRVGSGGLKY

SEQ ID NO: 740502 - protein, 148 aa, Homo sapiens
SFRPGFPAPTAHPRVQELPALGRDRGAGRMSPHGKRADGQAQGQLRLPPSTPRAPDRGGCEPRAPRSQELRSWAQPAGGRAPGCAAPWVPQCHPLPPGQSSAERYRALCPALPPSSAPSGAEAPRSPPLRLQRYTTAAAAPALQQRRA

SEQ ID NO: 740503 - protein, 181 aa, Homo sapiens
NLAVHRRAHTGEKPYGCQVCGKRFSKGERLVRHQRIHTGEKPYHCPACGRSFNQRSILNRHQKTQHRQEPLVQLSIAGGRQHHHSSFSLQGLAGCKVMAAGKHWSHRLPTHSPTRERQGLAYLELPESIAASISYPSGAKQFFFQCLREAVSCGSVQAEIFSFSGLSVSPCRTKLGVKAKP

SEQ ID NO: 740504 - protein, 181 aa, Homo sapiens; identical to SEQ ID NO: 740503

SEQ ID NO: 740505 - protein, 32 aa, Homo sapiens
MCSEEEMTRSQVQELVEYLDFGTAVFQGSSKF

SEQ ID NO: 740506 - protein, 120 aa, Homo sapiens
SCDGSGWLGGGRPFCDQNTLVIFFILPYFPMAEPCCDTSSFSVDVVLASHQLKRSYALLLVHIYIHNVFPFLILSFCLGSASCTPSLTQLLPSHLLSSDHFMFCFCYCLDEALLSIFSGP

SEQ ID NO: 740507 - protein, 115 aa, Homo sapiens [sequence omitted]

SEQ ID NO: 740508 - protein, 115 aa, Homo sapiens [sequence omitted]

SEQ ID NO: 740509 - protein, 115 aa, Homo sapiens [sequence omitted]

SEQ ID NO: 740510 - protein, 32 aa, Homo sapiens; identical to SEQ ID NO: 740505

SEQ ID NO: 740511 - protein, 303 aa, Homo sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQCYLYLFYSPARTMKVVLMLLFICLGNMYLHGLRNLWQILFHIGVAFLSSYQILTRQLQEKQSDCGV

SEQ ID NO: 740512 - protein, 250 aa, Homo sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 740513 - protein, 250 aa, Homo sapiens; identical to SEQ ID NO: 740512

SEQ ID NO: 740514 - protein, 250 aa, Homo sapiens; identical to SEQ ID NO: 740512

SEQ ID NO: 740515 - protein, 180 aa, Homo sapiens
MAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 740516 - protein, 180 aa, Homo sapiens; identical to SEQ ID NO: 740515

SEQ ID NO: 740517 - protein, 303 aa, Homo sapiens; identical to SEQ ID NO: 740511

SEQ ID NO: 740518 - protein, 105 aa, Homo sapiens [sequence omitted]

SEQ ID NO: 740519 - protein, 105 aa, Homo sapiens [sequence omitted]

SEQ ID NO: 740520 - protein, 105 aa, Homo sapiens [sequence omitted]

SEQ ID NO: 740521 - protein, 250 aa, Homo sapiens; identical to SEQ ID NO: 740512

SEQ ID NO: 740522 - protein, 257 aa, Homo sapiens
MLAHRGTMSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 740523 - protein, 250 aa, Homo sapiens; identical to SEQ ID NO: 740512

SEQ ID NO: 740524 - protein, 250 aa, Homo sapiens; identical to SEQ ID NO: 740512

SEQ ID NO: 740525 - protein, 180 aa, Homo sapiens; identical to SEQ ID NO: 740515

SEQ ID NO: 740526 - protein, 180 aa, Homo sapiens; identical to SEQ ID NO: 740515

SEQ ID NO: 740527 - protein, 180 aa, Homo sapiens; identical to SEQ ID NO: 740515

SEQ ID NO: 740528 - protein, 119 aa, Homo sapiens
MEDAKHLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 740529 - protein, 237 aa, Homo sapiens
MAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPGPNFRMEPVKGPRIPCPNVQPQVCGPRFKREGPPGTHLLRGAAEKGDQAGIKSPGEREFHITGKAARCAHTVGTPGRREENSPRREGKTRGRTHQRAEEEQKMRREPTAESNSRSINTARPTTLASELTSKT

SEQ ID NO: 740530 - protein, 959 aa, Homo sapiens
MEEMYFAWLENPQSVHKSWDSFFREASEEAFSGSAQPRPPSVVHESRSAVSSRTKTSKLVEDHLAVQSLIRAYQIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 740531 - protein, 112 aa, Homo sapiens
PAHRARTTRLVQGPAQRSGCSRMSQLRLLPSRLGVQAARLLAAHDVPVFGWRSRSSGPPATFPSSKGGGGSSYMEEMYFACVCGRSHPGSPGCCSPHPRLSVDSKRCSLLCS

SEQ ID NO: 740532 - protein, 129 aa, Homo sapiens
MSQLRLLPSRLGVQAARLLAAHDVPVFGWRSRSSGPPATFPSSKGGGGSSYMEEMYFAWLENPQSVHKSWDSFFREASEEAFSGSAQPRPPSVVHESRSAVSSRTKTSKLVEDHLAVQSLIRAYQVRGS

SEQ ID NO: 740533 - protein, 876 aa, Homo sapiens
MSQLRLLPSRLGVQAARLLAAHDVPVFGWRSRSSGPPATFPSSKGGGGSSYMEEMYFAWLENPQSVHKSWDSFFREASEEAFSGSAQPRPPSVVHESRSAVSSRTKTSKLVEDHLAVQSLIRAYQIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGMLAGTQRLHQPQETGTLTWCH

SEQ ID NO: 740534 - protein, 305 aa, Homo sapiens
MSQLRLLPSRLGVQAARLLAAHDVPVFGWRSRSSGPPATFPSSKGGGGSSYMEEMYFAWLENPQSVHKSWDSFFREASEEAFSGSAQPRPPSVVHESRSAVSSRTKTSKLVEDHLAVQSLIRAYQIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRWVPLPA

SEQ ID NO: 740535 - protein, 1010 aa, Homo sapiens
MSQLRLLPSRLGVQAARLLAAHDVPVFGWRSRSSGPPATFPSSKGGGGSSYMEEMYFAWLENPQSVHKSWDSFFREASEEAFSGSAQPRPPSVVHESRSAVSSRTKTSKLVEDHLAVQSLIRAYQIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 740536 - protein, 1001 aa, Homo sapiens
MSQLRLLPSRLGVQAARLLAAHDVPVFGWRSRSSGPPATFPSSKGGGGSSYMEEMYFAWLENPQSVHKSWDSFFREASEEAFSGSAQPRPPSVVHESRSAVSSRTKTSKLVEDHLAVQSLIRAYQIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 740537 - protein, 915 aa, Homo sapiens
MARRARTPSAQPPDLQPPDLAAARTRPARPIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 740538 - protein, 2701 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDTITALLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMRVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 740539 - protein, 2701 aa, Homo sapiens; identical to SEQ ID NO: 740538

SEQ ID NO: 740540 - protein, 2701 aa, Homo sapiens; identical to SEQ ID NO: 740538

SEQ ID NO: 740541 - protein, 2701 aa, Homo sapiens; identical to SEQ ID NO: 740538

SEQ ID NO: 740542 - protein, 2701 aa, Homo sapiens; identical to SEQ ID NO: 740538

SEQ ID NO: 740543 - protein, 2701 aa, Homo sapiens; identical to SEQ ID NO: 740538

SEQ ID NO: 740544 - protein, 2626 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDISGTLLKRQKKAPKLTSEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMREFWSWGDPKTALQDYNLNETNQCKATNGMKDVGFHCGMHVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 740545 - protein, 1139 aa, Homo sapiens
KWMAWRYGATAARTLDIQGRGHEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMREFWSWGDPKTALQDYNLNETNQCKATNGMKDVGFHCGMHVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 740546 - protein, 322 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAEAYQSQ

SEQ ID NO: 740547 - protein, 181 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNDASFWI

SEQ ID NO: 740548 - protein, 2701 aa, Homo sapiens; identical to SEQ ID NO: 740538

SEQ ID NO: 740549 - protein, 2740 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDTITALLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMREFWSWGDPKTALQDYNLNETNQCKATNGMKDVGFHCGMHVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 740550 - protein, 2740 aa, Homo sapiens; identical to SEQ ID NO: 740549

SEQ ID NO: 740551 - protein, 1826 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDTITALLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQVLVHQSWGLHLLLVFLVYLSQKPRKSNVFLLALITI

SEQ ID NO: 740552 - protein, 127 aa, Homo sapiens
LTVCLRRERERGEGDRQDRSGSRGSHGLYLNNLPFSFQASVHILLTFGTSVRQGASFLSLQEDSWGTWPLAASSWVSTCWASSWFIVHQWERTWVLLTCESFFTEGFRKVCSWPVDLDSKGDEKNRN

SEQ ID NO: 740553 - protein, 188 aa, Homo sapiens
LTVCLRRERERGEGDRQDRSGSRGSHGLYLNNLPFSFQASVHILLTFGTSVRQGASFLSLQEDSWGTWPLAASSWVSTCWASSWFIVHQWERTWVLLTCESFFTEGFRKVCSWPVDLDSKGDERTRLSCVAFLRQSTGKWPHFLCLSCPAPPLSCAGPRPSLSQSAELQTPNILSYPQNLQLPSMDVG

SEQ ID NO: 740554 - protein, 575 aa, Homo sapiens
MASWLRRKLRGKRRPVIAFCLLMILSAMAVTRFPPQRPSAGPDPGPMEPQGVTGAPATHIRQALSSSRRQRARNMGFWRSRALPRNSILVCAEEQGHRARVDRSRESPGGDLRHPGRVRRDITLSGHPRLSTQHVVLLREDEVGDPGTKDLGHPQHGSPIQETQSEVVTLVSPLPGSDMAALPAWRATSGLTLWPHTAEGRDLLGAENRALTGGQQAEDPTLASGAYQWPGSVEKLQGSVWCDAETLLSSSRTGGQAPPWLTDHDVQMLRLLAQGEVVDKARVPAHGQVLQVGFSTEAALQDLSSPRLSQLCSQGLCGLIKRPGDLPEVLSFHVDRVLGLRRSLPAVARRFHSPLLPYRYTDGGARPVIWWAPDVQHLSDPDEDQNSLALGWLQYQALLAHSCNWPGQAPCPGIHHTEWARLALFDFLLQVHDRLDRYCCGFEPEPSDPCVEERLREKCQNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTLFRDEDP

SEQ ID NO: 740555 - protein, 575 aa, Homo sapiens; identical to SEQ ID NO: 740554

SEQ ID NO: 740556 - protein, 187 aa, Homo sapiens
LVLDELVLSQEEPTQLLPSRHSSIQGRCGFQSRIPLTHRPGTMSKFYLSLNLTLASRTLGGSAEKLDLVPILARECEPMSHWRGTVRTNTTGQRSGPQELGPRETGLLRGDSVQAEACGPSQFDTGDDQESLSFSQNELRGPSFHYSDQDLHLRGAHWKFAEIPNQHAPDFRSCHPPLHFNTKSTTS

SEQ ID NO: 740557 - protein, 432 aa, Homo sapiens
LRWEPGGRAAAAAGGAPVRGAEARTGSCPWAGPGVPARREPADMPQTLSASDMVTPGSLSPPPTEPTDGEQAGQPLLDGAPSSASLETLIQHLVPTADYYPEKAYIFTFLLSSRLFIEPRELLARVCHLCIEQQQLDKPVLDKARVRKFGPKLLQLLAEWTETFPRDFQEESTIGHLKDVVGRIAPCDEAYRKRMHQLLQALHQKLAALRQGPEGLVGADKPISYRTKPPASIHRELLGVCSDPYTLAQQLTHVELERLRHIGPEEFVQAFVNKDPLASTKPCFSDKTSNLEAYVKWFNRLCYLVATEICMPAKKKQRAQVIEFFIDVARECFNIGNFNSLMAIISGMNMSPVSRLKKTWAKVRTAKFFILEHQMDPTGNFCNYRTALRGAAHRSLTAHSSREKIVIPFFSLLIKDIYFLNEGCANRLPNGH

SEQ ID NO: 740558 - protein, 312 aa, Homo sapiens
TRSEAHVPTRRPSRARCPSLAREARVRKFGPKLLQLLAEWTETFPRDFQEESTIGHLKDVVGRIAPCDEAYRKRMHQLLQALHQKLAALRQGPEGLVGADKPISYRTKPPASIHRELLGVCSDPYTLAQQLTHVELERLRHIGPEEFVQAFVNKDPLASTKPCFSDKTSNLEAYVKWFNRLCYLVATEICMPAKKKQRAQVIEFFIDVARECFNIGNFNSLMAIISGMNMSPVSRLKKTWAKVRTAKFFILEHQMDPTGNFCNYRTALRGAAHRSLTAHSSREKIVIPFFSLLIKDIYFLNEGCANRLPNGH

SEQ ID NO: 740559 - protein, 294 aa, Homo sapiens
MALLSTVRGATWGRLVTRHFSHAARHGERPGGEELSRLLLDDLVPTSRLELLFGMTPCLLALQAARRSVARLLLQAGKAGLQGKRAELLRMAEARDIPVLRPRRQKLDTMCRYQVHQVSAWSCPLTPVVSKSSAGAMEVMDVFSTDDLTGFLQTKAQQGWLVAGTVGCPSTEDPQSSEIPIMSCLEFLWERPTLLVLGNEGSGLSQEVQASCQLLLTILPRRQLPPGLESLNVSVAAGILLHSICSQRKGFPTEGERRQLLQDPQEPSARSEGLSMAQHPGLSSGPEKERQNEG

SEQ ID NO: 740560 - protein, 353 aa, Homo sapiens
MALLSTVRGATWGRLVTRHFSHAARHGERPGGEELSRLLLDDLVPTSRLELLFGMTPCLLALQAARRSVARLLLQAGKAGLQGKRAELLRMAEARDIPVLRPRRQKLDTMCRYQVHQGVCMEVSPLRPRPWREAGEASPGDDPQQLWLVLDGIQDPRNFGAVLRSAHFLGVDKVITSRRNSCPLTPVVSKSSAGAMEVMDVFSTDDLTGFLQTKAQQGWLVAGTVGCPSTEDPQSSEIPIMSCLEFLWERPTLLVLGNEGSGLSQEVQASCQLLLTILPRRQLPPGLESLNVSVAAGILLHSICSQRKGFPTEGERRQLLQDPQEPSARSEGLSMAQHPGLSSGPEKERQNEG

SEQ ID NO: 740561 - protein, 102 aa, Homo sapiens
GQCLIYDTHFIISSSIDNIMINTKHSSTHTEYSCITLGFFSFVCVCVCVCVCVCVCYETRSGSVTQAAVQCCSLGPCPTAASGIAVCRPGTVAQACRLSTLG

SEQ ID NO: 740562 - protein, 470 aa, Homo sapiens
AEREPSRGQLRRAGGALERSAAQPHQSAKRTELEVERCRGRRAMGAGATGRAMDGPRLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 740563 - protein, 563 aa, Homo sapiens
SLGLRAAPHLAARPERSAHRAPWAPAPRRVGIRSEPLLALGASRWAPNETGAPGRLGFCSAVSRATDSAKVGGSSGWSDEIVRCGLLYGHEPNALEGLATEEASSLSPPASFIRALRPKFRLYRYGDCGSESLNDLAKISQQVGPESWLDSSDLIPSSVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 740564 - protein, 470 aa, Homo sapiens; identical to SEQ ID NO: 740562

SEQ ID NO: 740565 - protein, 470 aa, Homo sapiens; identical to SEQ ID NO: 740562

SEQ ID NO: 740566 - protein, 470 aa, Homo sapiens; identical to SEQ ID NO: 740562

SEQ ID NO: 740567 - protein, 960 aa, Homo sapiens [sequence omitted]

SEQ ID NO: 740568 - protein, 960 aa, Homo sapiens [sequence omitted]

SEQ ID NO: 740569 - protein, 960 aa, Homo sapiens [sequence omitted]

SEQ ID NO: 740570 - protein, 960 aa, Homo sapiens [sequence omitted]

SEQ ID NO: 740571 - protein, 960 aa, Homo sapiens [sequence omitted]

SEQ ID NO: 740572 - protein, 960 aa, Homo sapiens [sequence omitted]

SEQ ID NO: 740573 - protein, 960 aa, Homo sapiens [sequence omitted]

SEQ ID NO: 740574 - protein, 845 aa, Homo sapiens
GESGTRGQLEKLKEDTEFQEFLSVHQRRAQAATWANDGLDAEPSKGKSKPASDYLNFDSDSGQESEEEGAGEDLEEEASLEPKAAVQKELSDMDYLKSKMVKAGSSSSSEEEESEDEAVHCDEGSEAEEEDSSATPVLQERDSKGAGQEQGMPAGKKRPPEARAETEKPANQKEPTTCHTVKLRGAPFNVTEKNVMEFLAPLKPVAIRIVRNAHGNKTGYIFVDFSNEEEVKQALKCNREYMGGRYIEVFREKNVPTTKGAPKNTTKSWQGRILGENEEEEDLAESGRLFVRNLPYTSTEEDLEKLFSKYGPLSELHYPIDSLTKKPKGFAFITFMFPEHAVKAYSEVDGQVFQGRMLHVLPSTIKKEASEDASALGSSSYKKKKEAQDKANSASSHNWNTLFMGPNAVADAIAQKYNATKSQVFDHETKGSVAVRVALGETQLVQEVRRFLIDNGVSLDSFSQAAAERSKTVILVKNLPAGTLAAELQETFGHFGSLGRVLLPEGGITAIVEFLEPLEARKAFRHLAYSKFHHVPLYLEWAPVGVFSSTAPQKKKLQDTPSEPMEKDPAEPETVPDGETPEDENPTEEGADNSSAKMEEEEEEEEEEEESLPGCTLFIKNLNFDTTEEKLKEVFSKVGTVKSCSISKKKNKAGVLLSMGFGFVEYRKPEQAQKALKQLQGHVVDGHKLEVRISERATKPAVTLARKKQVPRKQTTSKILVRNIPFQAHSREIRELFSTFGELKTVRLPKKMTGTGTHRGFGFVDFLTKQDAKRAFNALCHSTHLYGRRLVLEWADSEVTLQALRRKTAAHFHEPPKKKRSVVLDEILEQLEGSDSDSEEQTLQL

SEQ ID NO: 740575 - protein, 338 aa, Homo sapiens
QDFLSVSRVAEAQHKLGITVPLPATARRGRTPLPSGLFAVGPRALVGLTLFHGFDVFVFVFDFDGGSVPDGETPEDENPTEEGADNSSAKMEEEEEEEEEEEESLPGCTLFIKNLNFDTTEEKLKEVFSKVGTVKSCSISKKKNKAGVLLSMGFGFVEYRKPEQAQKALKQLQGHVVDGHKLEVRISERATKPAVTLARKKQVPRKQTTSKILVRNIPFQAHSREIRELFSTFGELKTVRLPKKMTGTGTHRGFGFVDFLTKQDAKRAFNALCHSTHLYGRRLVLEWADSEVTLQALRRKTAAHFHEPPKKKRSVVLDEILEQLEGSDSDSEEQTLQL

SEQ ID NO: 740576 - protein, 563 aa, Homo sapiens
MSRLIVKNLPNGMKEERFRQLFAAFGTLTDCSLKFTKDGKFRKFGFIGFKSEEEAQKAQKHFNKSFIDTSRITVEFCKSFGDPAKPRAWSKHAQKPSQPKQPPKDSTTPEIKKDEKKKKVAGQLEKLKEDTEFQEFLSVHQRRAQAATWANDGLDAEPSKGKSKPASDYLNFDSDSGQESEEEGAGEDLEEEASLEPKAAVQKELSDMDYLKSKMVKAGSSSSSEEEESEDEAVHCDEGSEAEEEDSSATPVLQERDSKGAGQEQGMPAGKKRPPEARAETEKPANQKEPTTCHTVKLRGAPFNVTEKNVMEFLAPLKPVAIRIVRNAHGNKTGYIFVDFSNEEEVKQALKCNREYMGGRYIEVFREKNVPTTKGAPKNTTKSWQGRILGENEEEEDLAESGRLFVRNLPYTSTEEDLEKLFSKYGPLSELHYPIDSLTKKPKGFAFITFMFPEHAVKAYSEVDGQVFQGRMLHVLPSTIKKEASEDASALGSSSYKKKKEAQDKANSASSHNWNTLFMGPNAVADAIAQKYNATKSQVFDHETKGSVAVRVALGETHLPLAS

SEQ ID NO: 740577 - protein, 239 aa, Homo sapiens
MSRLIVKNLPNGMKEERFRQLFAAFGTLTDCSLKFTKDGKFRKFGFIGFKSEEEAQKAQKHFNKSFIDTSRITVEFCKSFGDPAKPRAWSKHAQKPSQPKQPPKDSTTPEIKKDEKKKKVAGQLEKLKEDTEFQEFLSVHQRRAQAATWANDGLDAEPSKGKSKPASDYLNFDSDSGQESEEEGAGEDLEEEASLEPKAAVQKELSDMDYLKSKMVKASGHCPAAQASWVSPVTRSSRH

SEQ ID NO: 740578 - protein, 3602 aa, Homo sapiens
MAKRGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMSSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIISSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDIYSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSWLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 740579 - protein, 149 aa, Homo sapiens
MAKRGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKVSHLLFG

SEQ ID NO: 740580 - protein, 1136 aa, Homo sapiens
SGSPPRKYAVRWIVCLKVKLFFQQVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSWLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 740581 - protein, 197 aa, Homo sapiens
MAKRGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYRNPCSNIPKEPEEGSRDWHRE

SEQ ID NO: 740582 - protein, 1545 aa, Homo sapiens
MAKRGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMSSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLEPQDSCIMV

SEQ ID NO: 740583 - protein, 189 aa, Homo sapiens
MEMTREAIGPRCHLEDPSWGALFPGQAPPSSRSPSVAWNSSVSDPASTEWPRAGSVTSQSPRSCSPSLNLQFPSLGGLVTSGAKTCGQHFTVEEGPSHTKPDCKWLQRSPSSVVPKHGCVSKLPGDVVPNPDNWTVPDLQHQSLLSRGICIINSNQGRVSWLTPVIPALWEAEAGGSPEVRSLRPVWPK

SEQ ID NO: 740584 - protein, 189 aa, Homo sapiens; identical to SEQ ID NO: 740583

SEQ ID NO: 740585 - protein, 189 aa, Homo sapiens; identical to SEQ ID NO: 740583

SEQ ID NO: 740586 - protein, 991 aa, Homo sapiens
MDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740587 - protein, 991 aa, Homo sapiens; identical to SEQ ID NO: 740586

SEQ ID NO: 740588 - protein, 1135 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRSVWTTQPAVLSRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740589 - protein, 1179 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQRGKALFDRCMDSSKKLRSNCKEMACITQSPVCGNTEDPRGLENEHSAGASSRVAFSGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740590 - protein, 1255 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKSKVVCQGTYQTVIITMEQDGQCYVRELSAFQYPERSVHDLMTEAIAVCGPPVLLKGIYALQIVNCYMNAVRHDFRFLSIGEEKYAVFICLAFFYRTSLASSIYSKNDSQILGTSKIYLSLPCVALLPFMVDSAIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740591 - protein, 601 aa, Homo sapiens
MIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740592 - protein, 601 aa, Homo sapiens; identical to SEQ ID NO: 740591

SEQ ID NO: 740593 - protein, 553 aa, Homo sapiens
MGKAMTGRRDPPGRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRSVWTTQPAVLSRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740594 - protein, 277 aa, Homo sapiens [sequence omitted]

SEQ ID NO: 740595 - protein, 1102 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRRDDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740596 - protein, 981 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHK

SEQ ID NO: 740597 - protein, 719 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAVSFLHLGLA

SEQ ID NO: 740598 - protein, 658 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKSK

SEQ ID NO: 740599 - protein, 1123 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740600 - protein, 991 aa, Homo sapiens; identical to SEQ ID NO: 740586

SEQ ID NO: 740601 - protein, 971 aa, Homo sapiens [sequence omitted]

SEQ ID NO: 740602 - protein, 601 aa, Homo sapiens; identical to SEQ ID NO: 740591

SEQ ID NO: 740603 - protein, 277 aa, Homo sapiens [sequence omitted]

SEQ ID NO: 740604 - protein, 471 aa, Homo sapiens
MVDSAIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740605 - protein, 392 aa, Homo sapiens
LEDPCTGEIARRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 740606 - protein, 1132 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDRKLMVSASFADRKLVDKEDIDTSSKGGCVQQATGWRKGTGLGYGHPGLASSEEAEGRMRGPSVGASGRTSKRQSNETYRDAVRRVMFARYKELD

SEQ ID NO: 740607 - protein, 1017 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREEVNMRDRYSLD

SEQ ID NO: 740608 - protein, 695 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANLLTGDPYES

SEQ ID NO: 740609 - protein, 504 aa, Homo sapiens
CGGAKFEASGGAGARLRSRTCSSFFGCLGPLSPAIMPIRALCTICSDFFDHSRDVAAIHCGHTFHLQCLIQWFETAPSRTCPQCRIQVGKRTIINKLFFDLAQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 740610 - protein, 314 aa, Homo sapiens
CGGAKFEASGGAGARLRSRTCSSFFGCLGPLSPAIMPIRALCTICSDFFDHSRDVAAIHCGHTFHLQCLIQWFETAPSRTCPQCRIQVGKRTIINKLFFDLAQEEENVLDAEFLKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPVSFFC

SEQ ID NO: 740611 - protein, 498 aa, Homo sapiens
PGKKFPDGRLRSRTCSSFFGCLGPLSPAIMPIRALCTICSDFFDHSRDVAAIHCGHTFHLQCLIQWFETAPSRTCPQCRIQVGKRTIINKLFFDLAQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 740612 - protein, 482 aa, Homo sapiens
PGKKFPDGRLRSRTCSSFFGCLGPLSPAIMPIRALCTICSDFFDHSRDVAAIHCGHTFHLQCLIQWFETAPSRTCPQCRIQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 740613 - protein, 534 aa, Homo sapiens
CGGAKFEASGGAGARLRSRTCSSFFGCLGPLSPAIMPIRALCTICSDFFDHSRDVAAIHCGHTFHLQCLIQWFETAPSRTCPQCRIQVGKRTIINKLFFDLAQEEENVLDAEFLKNELDNVRAQLSQKEDEALNPRAQVLLLMDGQAFPFPPPSTPAPDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 740614 - protein, 337 aa, Homo sapiens
PGSGGVERSLAGVGTQAPPRRPGGEMAAGQNGHEEWVGSAYLFVESSLDKVVLSDAYAHPQQKVAVYRALQAALAESGGSPDVLQMLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 740615 - protein, 252 aa, Homo sapiens
MLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 740616 - protein, 341 aa, Homo sapiens
MLSEAGVLARELEPGFLWNPVPAEAAGGEMAAGQNGHEEWVGSAYLFVESSLDKVVLSDAYAHPQQKVAVYRALQAALAESGGSPDVLQMLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 740617 - protein, 129 aa, Homo sapiens
MAQGGALTAARLPGAAGPGAGLAGLRVRARGTVRAGLPAAAALRAGRGPPRHAAAPGGGTRGERAHQPGRGLAGPDRSQWRPGLDQGCSQLLENLDGLRVPSAAIAEPLSIHGTLKLHLAYLLDLLGQS

SEQ ID NO: 740618 - protein, 129 aa, Homo sapiens; identical to SEQ ID NO: 740617

SEQ ID NO: 740619 - protein, 383 aa, Homo sapiens
RLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQVFEQDKRFSKLRIEVNGIVCLQKPAEKRRGLQMF

SEQ ID NO: 740620 - protein, 101 aa, Homo sapiens
RQLCAVGTINIITPTLKWKKPRQEVVGSGAEPCRSASGPVGLLFLANSEQITRQSQATVNVMQTQAGRHHCLHWSLPCWASLSSLTRGSVVPPSSWGLRVS

SEQ ID NO: 740621 - protein, 146 aa, Homo sapiens
SWVKFTRRLLKCLLRGNLCLSLSLSLSLSLSLSLSLSLSLSLSQCISLLSFTFPFFLSKNNVLVEALVTLINQNLPFPVSLFLRPFHPHYLLLPRNMTDHQDAARREDLSQKPTSKMGGRCGLRSSAMHPKPLTFPLWEVHWDDRN

SEQ ID NO: 740622 - protein, 95 aa, Homo sapiens
MEIIWVYGTVCGWPYWVVFLHCLRDRWRGTAAHGPRLWGFWKVPRRAGAMPGGVQQMPGPAPCANLAWEAQAQLFQGSFISFLVHFKVSVSCSEQ

SEQ ID NO: 740623 - protein, 141 aa, Homo sapiens
HPQLLTEELSQIPWGWKGQCDTVHPHLLTEELSDSVGLERVSVIPCTHTYSPRSSRIPWGWKGQCDTVHPHLLTEELLDSVFSSLPMCRKSTASMRTAGTHPPTRTPKHTRMHVHVHTHTLVHAHVHAHTHRATSCSSHLF

SEQ ID NO: 740624 - protein, 112 aa, Homo sapiens [sequence omitted]

SEQ ID NO: 740625 - protein, 129 aa, Homo sapiens
LFPASLSPSSLLGNSPPSWLRHNSESKVSAVSSPSATKTLSTGIGKLDPGHKEMAEESELLKNKMQAPPLSRCPESQKCQHQLRLHHWKPSVRHQVKRCSPAVLRSAMPPADCPAVLEATTATREETVM

SEQ ID NO: 740626 - protein, 126 aa, Homo sapiens
LESSQGQAVPVGLALTLGAWPGSQRSLPRMAASAPALWSPMLGEEGKAERMAEEDLRGPGRMQTSLPPARISLLGSLWATAFCKVVLRLHLRSGRGRVQWLMPVIPALWEAEAGGSPEVKSLRPAW

SEQ ID NO: 740627 - protein, 577 aa, Homo sapiens
MCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSCTNVLQSNSTKKCGIDTIDLKRNETPPVPPPRSTSRNFPSSDSEQAYERWKERLDHNSWVPHEGRSKRNYNPHFPLRQQEMSMLYPNEGKTSKDGIIFSSLVPEVKIDSKPPSNEDVGLSMWSCDIGIGAKRSPSTSWFQKTCSTPSNPKYEMVIPDHPAKSHPDLHVSNDCSSSVAESSSPLRNFSCGFERTTRNEKLAAKTDEFNRTVFRTDRNCQAIQQNHSCSKSSEDLKPCDTSSTHTGSISQSNDVSGIWKTNAHMPVPMENVPDNPTKKSTTGLVRQMQGHLSPRSYRNMLHEHDWRPSNLSGRPRSADPRSNYGVVEKLLKTYETATESALQNSKCFQDNWTKCNSDVSGGATLSQHLEMLQMEQQFQQKTAVWGGQEVKQGIDPKKITEESMSVNASHGKGFSRPARPANRRLPSRWASRSPSAPPALRRTTHNYTISLRSEALMV

SEQ ID NO: 740628 - protein, 261 aa, Homo sapiens
SGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQVQFCLLRATAVARLARGAASLGGVSAPGLPRPA

SEQ ID NO: 740629 - protein, 1066 aa, Homo sapiens
SGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQMFQPIILLILILVLFSSLSYTTIFKLVFLFTLFFVLKIFHHLPFIVVFSVCLFCSPFKTRSKRSIISVVTNAIKTLKTAYFFKKIQLILPRPNSIRSPNTKIFQALFQRQVRLLQIKQLQASKKQLRGGREEQKHFFADTYTVAMDLHKQWENTETNWHKEKMELLDQFDNERKEWESQWKIMQKKIEELCREVKLWRKININERAKIIDLYHEKTIPEKVIESSPNYPDLGQSEFIRTNHKDGLRKENKREQSLVSGGNQMCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSCTNVLQSNSTKKCGIDTIDLKRNETPPVPPPRSTSRNFPSSDSEQAYERWKERLDHNSWVPHEGRSKRNYNPHFPLRQQEMSMLYPNEGKTSKDGIIFSSLVPEVKIDSKPPSNEDVGLSMWSCDIGIGAKRSPSTSWFQKTCSTPSNPKYEMVIPDHPAKSHPDLHVSNDCSSSVAESSSPLRNFSCGFERTTRNEKLAAKTDEFNRTVFRTDRNCQAIQQNHSCSKSSEDLKPCDTSSTHTGSISQSNDVSGIWKTNAHMPVPMENVPDNPTKKSTTGLVRQMQGHLSPRSYRNMLHEHDWRPSNLSGRPRSADPRSNYGVVEKLLKTYETATESALQNSKCFQDNWTKCNSDVSGGATLSQHLEMLQMEQQFQQKTAVWGGQEVKQGIDPKKITEESMSVNASHGKGFSRPARPANRRLPSRWASRSPSAPPALRRTTHNYTISLRSEALMV

SEQ ID NO: 740630 - protein, 1008 aa, Homo sapiens
SGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQTRSKRSIISVVTNAIKTLKTAYFFKKIQLILPRPNSIRSPNTKIFQALFYRQVRLLQIKQLQASKKQLRGGREEQKHFFADTYTVAMDLHKQWENTETNWHKEKMELLDQFDNERKEWESQWKIMQKKIEELCREVKLWRKININERAKIIDLYHEKTIPEKVIESSPNYPDLGQSEFIRTNHKDGLRKENKREQSLVSGGNQMCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSCTNVLQSNSTKKCGIDTIDLKRNETPPVPPPRSTSRNFPSSDSEQAYERWKERLDHNSWVPHEGRSKRNYNPHFPLRQQEMSMLYPNEGKTSKDGIIFSSLVPEVKIDSKPPSNEDVGLSMWSCDIGIGAKRSPSTSWFQKTCSTPSNPKYEMVIPDHPAKSHPDLHVSNDCSSSVAESSSPLRNFSCGFERTTRNEKLAAKTDEFNRTVFRTDRNCQAIQQNHSCSKSSEDLKPCDTSSTHTGSISQSNDVSGIWKTNAHMPVPMENVPDNPTKKSTTGLVRQMQGHLSPRSYRNMLHEHDWRPSNLSGRPRSADPRSNYGVVEKLLKTYETATESALQNSKCFQDNWTKCNSDVSGGATLSQHLEMLQMEQQFQQKTAVWGGQEVKQGIDPKKITEESMSVNASHGKGFSRPARPANRRLPSRWASRSPSAPPALRRTTHNYTISLRSEALMV

SEQ ID NO: 740631 - protein, 706 aa, Homo sapiens
MDLHKQWENTETNWHKEKMELLDQFDNERKEWESQWKIMQKKIEEASTLVLLSTELSLCREVKLWRKININERAKIIDLYHEKTIPEKVIESSPNYPDLGQSEFIRTNHKDGLRKENKREQSLVSGGNQMCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSCTNVLQSNSTKKCGIDTIDLKRNETPPVPPPRSTSRNFPSSDSEQAYERWKERLDHNSWVPHEGRSKRNYNPHFPLRQQEMSMLYPNEGKTSKDGIIFSSLVPEVKIDSKPPSNEDVGLSMWSCDIGIGAKRSPSTSWFQKTCSTPSNPKYEMVIPDHPAKSHPDLHVSNDCSSSVAESSSPLRNFSCGFERTTRNEKLAAKTDEFNRTVFRTDRNCQAIQQNHSCSKSSEDLKPCDTSSTHTGSISQSNDVSGIWKTNAHMPVPMENVPDNPTKKSTTGLVRQMQGHLSPRSYRNMLHEHDWRPSNLSGRPRSADPRSNYGVVEKLLKTYETATESALQNSKCFQDNWTKCNSDVSGGATLSQHLEMLQMEQQFQQKTAVWGGQEVKQGIDPKKITEESMSVNASHGKGFSRPARPANRRLPSRWASRSPSAPPALRRTTHNYTISLRSEALMV

SEQ ID NO: 740632 - protein, 694 aa, Homo sapiens [sequence omitted]

SEQ ID NO: 740633 - protein, 871 aa, Homo sapiens
SGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQMFQPIILLILILVLFSSLSYTTIFKLVFLFTLFFVLKIFHHLPFIVVFSVCLFCSPFKTRSKRSIISVVTNAIKTLKTAYFFKKIQLILPRPNSIRSPNTKIFQALFQRQVRLLQIKQLQASKKQLRGGREEQKHFFADTYTVAMDLHKQWENTETNWHKEKMELLDQFDNERKEWESQWKIMQKKIEELCREVKLWRKININERAKIIDLYHEKTIPEKVIESSPNYPDLGQSEFIRTNHKDGLRKENKREQSLVSGGNQMCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSCTNVLQSNSTKKCGIDTIDLKRNETPPVPPPRSTSRNFPSSDSEQAYERWKERLDHNSWVPHEGRSKRNYNPHFPLRQQEMSMLYPNEGKTSKDGIIFSSLVPEVKIDSKPPSNEDVGLSMWSCDIGIGAKRSPSTSWFQKTCSTPSNPKYEMVIPDHPAKSHPDLHVSNDCSSSVAESSSPLRNFSCGFERTTRNEKLAAKTDEFNRTVFRTDRNCQAIQQNHSCSKSSEDLKPCDTSSTHTGIHVSERLTWKRIFPTC

SEQ ID NO: 740634 - protein, 1066 aa, Homo sapiens; identical to SEQ ID NO: 740629

SEQ ID NO: 740635 - protein, 871 aa, Homo sapiens; identical to SEQ ID NO: 740633

SEQ ID NO: 740636 - protein, 264 aa, Homo sapiens
SGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQMFQPIILLILILVLFSSLSYTTIFKLVFLFTLFFVL

SEQ ID NO: 740637 - protein, 224 aa, Homo sapiens
MVEDELALFDKSINEFWNKFKSTDTSCQMAGLRDTYKDSIKAFAEKLSVKLKEEERMVEMFLEYQNQISRQNKLIQEKKDNLLKLIAEVKGKKQELEVLTANIQDLKEEYSRKKETISTANKANAERLKRLQKSADLYKDRLGLEIRKIYGEKLQFIFTNIDPKNPESPFMFSLHLNEARDYEVSDSAPHLEGLAEFQENVRKTNNFSAFLANVRKAFTATVYN

SEQ ID NO: 740638 - protein, 224 aa, Homo sapiens; identical to SEQ ID NO: 740637

SEQ ID NO: 740639 - protein, 244 aa, Homo sapiens
MVEDELALFDKSINEFWNKFKSTDTSCQMAGLRDTYKDSIKAFAEKLSVKLKEEERMVEMFLEYQNRTVLNALHSPPPSVLMIVLQEISRQNKLIQEKKDNLLKLIAEVKGKKQELEVLTANIQDLKEEYSRKKETISTANKANAERLKRLQKSADLYKDRLGLEIRKIYGEKLQFIFTNIDPKNPESPFMFSLHLNEARDYEVSDSAPHLEGLAEFQENVRKTNNFSAFLANVRKAFTATVYN

SEQ ID NO: 740640 - protein, 151 aa, Homo sapiens
MVEDELALFDKSINEFWNKFKSTDTSCQMAGLRDTYKDSIKAFAEKLSVKLKEEERMVEMFLEYQNQISRQNKLIQEKKDNLLKLIAEVKGKKQELEVLTANIQDLKEEYSRKKETISTANKANAERLKRLQKSADLYKDRLGLEIRKIYA

SEQ ID NO: 740641 - protein, 109 aa, Homo sapiens
MVEDELALFDKSINEFWNKFKSTDTSCQMAGLRDTYKDSIKAFAEKLSVKLKEEERMVEMFLEYQNQISRQNKLIQEKKDNLLKLIAEVKGKKQELELFLLLIKRMQRG

SEQ ID NO: 740642 - protein, 139 aa, Homo sapiens
RELELAELDQWPQERESDQHVVPTAPDTEADNCIVHELTGQSSLLRRPVRPKRAEPREASPLHSLGHLIMDQSYVCALIAMMVWSITYHSWLTFVLLLWACLIWTVRSATNLAMLCSPCILLYGMTLCCLRYVWAMDLP

SEQ ID NO: 740643 - protein, 67 aa, Homo sapiens
SAAEAVAAGSWEEPRFTLGKASCELSGAGRVPAAVVVRQGRRGPNPSSDSCLLPNRAFHPTGPQGLR

SEQ ID NO: 740644 - protein, 67 aa, Homo sapiens; identical to SEQ ID NO: 740643

SEQ ID NO: 740645 - protein, 74 aa, Homo sapiens
LLKQLRVSSAWWPAMFGFAMKYGTSRWKPSYSILWEALQQVLSHTTAPRTAFSSTQKLYYQQVLPAQHLSKFLH

SEQ ID NO: 740646 - protein, 115 aa, Homo sapiens
MAFLGDSSLPSFSCRYNQGKESPLQCSGLVESGQPCRWAQVPGGQALGIPPWISPILPSFLFSLPSCFPNDCPPLLFSGHLLSTGAADPLDKGPARSWGNSASGWSRWRLGQLGP

SEQ ID NO: 740647 - protein, 615 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQVH

SEQ ID NO: 740648 - protein, 304 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLEEFPVQGPAAVCAGL

SEQ ID NO: 740649 - protein, 203 aa, Homo sapiens
FSCPSLGPLQLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQVH

SEQ ID NO: 740650 - protein, 303 aa, Homo sapiens
MVQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPKLPQTMNFIKMQMSDLHLLMQLS

SEQ ID NO: 740651 - protein, 143 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQVMWVTCFGVLA

SEQ ID NO: 740652 - protein, 466 aa, Homo sapiens
MGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAVFLITVWNFELYMIPLALLLIFVYNFIRPVKGKVSSIQDSQESTDIDDEEDEDDKESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 740653 - protein, 425 aa, Homo sapiens
MGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAESTDIDDEEDEDDKESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 740654 - protein, 466 aa, Homo sapiens; identical to SEQ ID NO: 740652

SEQ ID NO: 740655 - protein, 108 aa, Homo sapiens
MSFEWSSVIPKKEMLLVVLGPGIGLQLSLVEEVLILAQRRAMQLSLGDVVHVVVSECVLRFLDGLQFPMQIQCIFCFFASTTWNLYVQDGAISAMTTENVPLSREEEG

SEQ ID NO: 740656 - protein, 112 aa, Homo sapiens
GRRHRPGFGAGASGEVPVGALERPLFLQGPRWRALRRPPYSAPSGRQYPPEAGYPLWARIPALGPEHPRRCPPRAPQRLRWRGGGPGSARRGGSEGWRTRATGLRGVWPGWD

SEQ ID NO: 740657 - protein, 88 aa, Homo sapiens
AIRDLILQLDYPYTQGSQDSALLQLLEIRDRVNKLSPPGQRRLDLFSCLLRHRLKLSTSEVVRIQSALQAFNAKLPNTMDYDTTKLCS

SEQ ID NO: 740658 - protein, 1000 aa, Homo sapiens
MKLTTGLDSRWLSCRGREESELDEDPAAEPAEAGVGTTVAPLPPAPAPSSQPVPAGMTVPPPPAAAPPLPRALAKPAVFIPVNRSPEMQEERLKLPILSEEQVIMEAVAEHPIVIVCGETGSGKTTQVPQFLYEAGFSSEDSIIGVTEPRRVAAVAMSQRVAKEMNLSQRVVSYQIRYEGNVTEETRIKFMTDGVLLKEIQKDFLLLRYKVVIIDEAHERSVYTDILIGLLSRIVTLRAKRNLPLKLLIMSATLRVEDFTQNPRLFAKPPPVIKVESRQFPVTVHFNKRTPLEDYSGECFRKVCKIHRMLPAGGILVFLTGQAEVHALCRRLRKAFPPSRARPQEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKVINFPFPTPPSVEALLAAEELLIALGALQPPQKAERVKQLQENRLSCPITALGRTMATFPVAPRYAKMLALSRQHGCLPYAITIVASMTVRELFEELDRPAASDEELTRLKSKRARVAQMKRTWAGQGASLKLGDLMVLLGAVGACEYASCTPQFCEANGLRYKAMMEIRRLRGQLTTAVNAVCPEAELFVDPKMQPPTESQVTYLRQIVTAGLGDHLARRVQSEEMLEDKWRNAYKTPLLDDPVFIHPSSVLFKELPEFVVYQEIVETTKMYMKGVSSVEVQWIPALLPSYCQFDKPLEEPAPTYCPERGRVLCHRASVFYRVGWPLPAIEVDFPEGIDRYKHFARFLLEGQVFRKLASYRSCLLSSPGTMLKTWARLQPRTESLLRALVAEKADCHEALLAAWKKNPKYLLAEYCEWLPQAMHPDIEKAWPPTTVH

SEQ ID NO: 740659 - protein, 801 aa, Homo sapiens
MPPFHEPLSVTGSSHGEAHERSVYTDILIGLLSRIVTLRAKRNLPLKLLIMSATLRVEDFTQNPRLFAKPPPVIKVESRQFPVTVHFNKRTPLEDYSGECFRKVCKIHRMLPAGGILVFLTGQAEVHALCRRLRKAFPPSRARPQEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKVINFPFPTPPSVEALLAAEELLIALGALQPPQKAERVKQLQENRLSCPITALGRTMATFPVAPRYAKMLALSRQHGCLPYAITIVASMTVRELFEELDRPAASDEELTRLKSKRARVAQMKRTWAGQGASLKLGDLMVLLGAVGACEYASCTPQFCEANGLRYKAMMEIRRLRGQLTTAVNAVCPEAELFVDPKMQPPTESQVTYLRQIVTAGLGDHLARRVQSEEMLEDKWRNAYKTPLLDDPVFIHPSSVLFKELPEFVVYQEIVETTKMYMKGVSSVEVQWIPALLPSYCQFDKPLEEPAPTYCPERGRVLCHRASVFYRVGWPLPAIEVDFPEGIDRYKHFARFLLEGQVFRKLASYRSCLLSSPGTMLKTWARLQPRTESLLRALVAEKADCHEALLAAWKKNPKYLLAEYCEWLPQAMHPDIEKAWPPTTVH

SEQ ID NO: 740660 - protein, 1000 aa, Homo sapiens; identical to SEQ ID NO: 740658

SEQ ID NO: 740661 - protein, 1000 aa, Homo sapiens; identical to SEQ ID NO: 740658

SEQ ID NO: 740662 - protein, 743 aa, Homo sapiens
GALLVRPLEAHPGLVAMGKLRLRYNIKGRQQAGPGPSKGPPEPPPVQLELEDKDTLKGVDASNALVLPGKKKKKTKAPPLSKKEKKPLTKKEKKVLQKILEQKEKKSQRAEMLQKLSEVQASEAEMRLFYTTSKLGTGNRMYHTKEKADEVVAPGQEKISSLSGAHRKRRRWPSAEEEEEEEEESESELEEESELDEDPAAEPAEAGVGTTVAPLPPAPAPSSQPVPAGMTVPPPPAAAPPLPRALAKPAVFIPVNRSPEMQEERLKLPILSEEQVIMEAVAEHPIVIVCGETGSGKTTQVPQFLYEAGFSSEDSIIGVTEPRRVAAVAMSQRVAKEMNLSQRVVSYQIRYEGNVTEETRIKFMTDGVLLKEIQKDFLLLRYKVVIIDEAHERSVYTDILIGLLSRIVTLRAKRNLPLKLLIMSATLRVEDFTQNPRLFAKPPPVIKVESRQFPVTVHFNKRTPLEDYSGECFRKVCKIHRMLPAGGILVFLTGQAEVHALCRRLRKAFPPSRARPQEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYSSWPALRKWVKPWEPSSMRARSRMKGAAARAIWPGGDFLNCLLYGG

SEQ ID NO: 740663 - protein, 261 aa, Homo sapiens
MRGWVAEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKSSIPLPDAPSGKPSGARSVDAWWPERPEGKVAWGTWC

SEQ ID NO: 740664 - protein, 1191 aa, Homo sapiens
GALLVRPLEAHPGLVAMGKLRLRYNIKGRQQAGPGPSKGPPEPPPVQLELEDKDTLKGVDASNALVLPGKKKKKTKAPPLSKKEKKPLTKKEKKVLQKILEQKEKKSQRAEMLQKLSEVQASEAEMRLFYTTSKLGTGNRMYHTKEKADEVVAPGQEKISSLSGAHRKRRRWPSAEEEEEEEEESESELEEESELDEDPAAEPAEAGVGTTVAPLPPAPAPSSQPVPAGMTVPPPPAAAPPLPRALAKPAVFIPVNRSPEMQEERLKLPILSEEQVIMEAVAEHPIVIVCGETGSGKTTQVPQFLYEAGFSSEDSIIGVTEPRRVAAVAMSQRVAKEMNLSQRVVSYQIRYEGNVTEETRIKFMTDGVLLKEIQKDFLLLRYKVVIIDEAHERSVYTDILIGLLSRIVTLRAKRNLPLKLLIMSATLRVEDFTQNPRLFAKPPPVIKVESRQFPVTVHFNKRTPLEDYSGECFRKVCKIHRMLPAGGILVFLTGQAEVHALCRRLRKAFPPSRARPQEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKVINFPFPTPPSVEALLAAEELLIALGALQPPQKAERVKQLQENRLSCPITALGRTMATFPVAPRYAKMLALSRQHGCLPYAITIVASMTVRELFEELDRPAASDEELTRLKSKRARVAQMKRTWAGQGASLKLGDLMVLLGAVGACEYASCTPQFCEANGLRYKAMMEIRRLRGQLTTAVNAVCPEAELFVDPKMQPPTESQVTYLRQIVTAGLGDHLARRVQSEEMLEDKWRNAYKTPLLDDPVFIHPSSVLFKELPEFVVYQEIVETTKMYMKGVSSVEVQWIPALLPSYCQFDKPLEEPAPTYCPERGRVLCHRASVFYRVGWPLPAIEVDFPEGIDRYKHFARFLLEGQVFRKLASYRSCLLSSPGTMLKTWARLQPRTESLLRALVAEKADCHEALLAAWKKNPKCEFDQGQGVGVDRMGSLRQGLCALCTVSPGLAEGSGPTAAGQLFAT

SEQ ID NO: 740665 - protein, 669 aa, Homo sapiens
STITGVCSEAWVAEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKVINFPFPTPPSVEALLAAEELLIALGALQPPQKAERVKQLQENRLSCPITALGRTMATFPVAPRYAKMLALSRQHGCLPYAITIVASMTVRELFEELDRPAASDEELTRLKSKRARVAQMKRTWAGQGASLKLGDLMVLLGAVGACEYASCTPQFCEANGLRYKAMMEIRRLRGQLTTAVNAVCPEAELFVDPKMQPPTESQVTYLRQIVTAGLGDHLARRVQSEEMLEDKWRNAYKTPLLDDPVFIHPSSVLFKELPEFVVYQEIVETTKMYMKGVSSVEVQWIPALLPSYCQFDKPLEEPAPTYCPERGRVLCHRASVFYRVGWPLPAIEVDFPEGIDRYKHFARFLLEGQVFRKLASYRSCLLSSPGTMLKTWARLQPRTESLLRALVAEKADCHEALLAAWKKNPKYLLAEYCEWLPQAMHPDIEKAWPPTTVH

SEQ ID NO: 740666 - protein, 104 aa, Homo sapiens
MPSQLFTLLGGAGGVVMPALLSGPQQQPVCALAACHQRAFLPHRLQPRTESLLRALVAEKADCHEALLAAWKKNPKYLLAEYCEWLPQAMHPDIEKAWPPTTVH

SEQ ID NO: 740667 - protein, 223 aa, Homo sapiens
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMF

SEQ ID NO: 740668 - protein, 223 aa, Homo sapiens; identical to SEQ ID NO: 740667

SEQ ID NO: 740669 - protein, 223 aa, Homo sapiens; identical to SEQ ID NO: 740667

SEQ ID NO: 740670 - protein, 223 aa, Homo sapiens; identical to SEQ ID NO: 740667

SEQ ID NO: 740671 - protein, 184 aa, Homo sapiens
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKGNCQQLTFSIPPPHVVCPCNL

SEQ ID NO: 740672 - protein, 148 aa, Homo sapiens
MCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMF

SEQ ID NO: 740673 - protein, 223 aa, Homo sapiens; identical to SEQ ID NO: 740667

SEQ ID NO: 740674 - protein, 184 aa, Homo sapiens; identical to SEQ ID NO: 740671

SEQ ID NO: 740675 - protein, 251 aa, Homo sapiens [sequence omitted]

SEQ ID NO: 740676 - protein, 252 aa, Homo sapiens
KETSKQGEAQRALRTHAPVGSAGSQALQCYSFEHTYFGPFDLRAMKLPSISCPHECFEAILSLDTGYRAPVTLVRKGCWTGPPAGQTQSNPDALPPDYSVVRGCTTDKCNAHLMTHDALPNLSQAPDPPTLSGAECYACIGVHQDDCAIGRSRRVQCHQDQTACFQGNGRMTVGNFSVPVYIRTCHRPSCTTEGTTSPWTAIDLQGSCCEGYLCNRKSMTQPFTSASATTPPRALQVLALLLPVLLLVGLSA

SEQ ID NO: 740677 - protein, 251 aa, Homo sapiens [sequence omitted]

SEQ ID NO: 740678 - protein, 163 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADQVDAGCLQTLYSI

SEQ ID NO: 740679 - protein, 167 aa, Homo sapiens
MHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLRGRVARCDASIARLSAEHKTTYEGLQHLNKEQQAAKLI

SEQ ID NO: 740680 - protein, 135 aa, Homo sapiens
MHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLRGRVAR

SEQ ID NO: 740681 - protein, 145 aa, Homo sapiens [sequence omitted]

SEQ ID NO: 740682 - protein, 173 aa, Homo sapiens
MHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLRGRVARMNSSLLSVILGDDTLLTPSSLSTLALYLSAVINFFVSP

SEQ ID NO: 740683 - protein, 200 aa, Homo sapiens
RSGIPGSRGEARRGAQAAAATATYSRQWWRRRRRRPRAGITQVTCTGNQFAEINQRFLKLKKSCSLYRRFQPWQEECGPSWNPSGHTLLASSRKDAAAQREAQEGDLQGQEGAEASHAGGPAADHYSGTAHAGRGRALDRGVCVRGHAPHHHRVSPAAGRGPHRQGEEAREGDANKKWLSYSEMFMLLSCKQEHPVFSGL

SEQ ID NO: 740684 - protein, 195 aa, Homo sapiens
RSGIPGSRGEARRGAQAAAATATYSRQWWRRRRRRPRAGITQVTCTGNQFAEINQRFLKLKKRRFQPWQEECGPSWNPSGHTLLASSRKDAAAQREAQEGDLQGQEGAEASHAGGPAADHYSGTAHAGRGRALDRGVCVRGHAPHHHRVSPAAGRGPHRQGEEAREGDANKKWLSYSEMFMLLSCKQEHPVFSGL

SEQ ID NO: 740685 - protein, 139 aa, Homo sapiens [sequence omitted]

SEQ ID NO: 740686 - protein, 146 aa, Homo sapiens
PALCQALSYTASYSILTTVPRRRFQPWQEECGPSWNPSRKDAAAQREAQEGDLQGQEGAEASHAGGPAADHYSGTAHAGRGRALDRGVCVRGHAPHHHRVSPAAGRGPHRQGEEAREGDANKKWLSYSEMFMLLSCKQEHPVFSGL

SEQ ID NO: 740687 - protein, 195 aa, Homo sapiens; identical to SEQ ID NO: 740684

SEQ ID NO: 740688 - protein, 174 aa, Homo sapiens
VSPLQRPNQRLVGITQVTCTGNQFAEINQRFLKLKKSCSLYRRFQPWQEECGPSWNPSGHTLLASSRKDAAAQREAQEGDLQGQEGAEASHAGGPAADHYSGTAHAGRGRALDRGVCVRGHAPHHHRVSPAAGRGPHRQGEEAREGDANKKWLSYSEMFMLLSCKQEHPVFSGL

SEQ ID NO: 740689 - protein, 314 aa, Homo sapiens
QSWGRGHFGSMLRGSASSTSMEKAKGKEWTSTEKSREEDQQASNQPNSIALPGTSAKRTKEKMSVKGSKVLCPKKKAEHTDNPRPQKKIPIPPLPSKLPPVNLIHRDILRAWCQQLKLSSKGQKLDAYKRLCAFAYPNQKDFPSTAKEAKIRKSLQKKLKVEKGETSLQSSETHPPEVALPPVGEPPALENSTALLEGVNTVVVTTSAPEALLASWARISARARTPEAVESPQEASGVRWCVVHGKSLPADTDGWVHLQFHAGQAWVPEKQEGRVSALFLLPASNFPPPHLEDNMLCPKCVHRNKVLIKSLQWE

SEQ ID NO: 740690 - protein, 314 aa, Homo sapiens; identical to SEQ ID NO: 740689

SEQ ID NO: 740691 - protein, 314 aa, Homo sapiens; identical to SEQ ID NO: 740689

SEQ ID NO: 740692 - protein, 314 aa, Homo sapiens; identical to SEQ ID NO: 740689

SEQ ID NO: 740693 - protein, 201 aa, Homo sapiens
MEYLIGIQGPDYVLVASDRVAASNIVQMKDDHDKMFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 740694 - protein, 205 aa, Homo sapiens
MEYLIGIQGPDYVLVASDRVAASNIVQMKDDHDKMFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPGKWEGGHD

SEQ ID NO: 740695 - protein, 182 aa, Homo sapiens
FRSVVVITFASHHDKMFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 740696 - protein, 201 aa, Homo sapiens; identical to SEQ ID NO: 740693

SEQ ID NO: 740697 - protein, 201 aa, Homo sapiens; identical to SEQ ID NO: 740693

SEQ ID NO: 740698 - protein, 201 aa, Homo sapiens; identical to SEQ ID NO: 740693

SEQ ID NO: 740699 - protein, 201 aa, Homo sapiens; identical to SEQ ID NO: 740693

SEQ ID NO: 740700 - protein, 167 aa, Homo sapiens
MFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 740701 - protein, 201 aa, Homo sapiens; identical to SEQ ID NO: 740693

SEQ ID NO: 740702 - protein, 160 aa, Homo sapiens
MEYLIGIQGPDYVLVASDRVAASNIVQMKDGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 740703 - protein, 219 aa, Homo sapiens
MEYLIGIQGPDYVLVASDRVAASNIVQMKDDHDKMFKMSEKILLLCVGEAGDTVQFAEYIQKNVQLYKMRNGYELSPTAAANFTRRRSIVKVSLHPAVMSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHFNCEKDICWWHLKKTLKNIT

SEQ ID NO: 740704 - protein, 143 aa, Homo sapiens
MEYLIDHDKMFKMSEKILLLCVGEAGDTVQFAEYIQTANFTRRNLADCLRSRTPYHVNLLLAGYDEHEGPALYYMDYLAALAKAPFAAHGYGAFLTLSILDRYYTPIILRVRAAVPLSKCLFAAPIFVSSLILTTLQMAPTLT

SEQ ID NO: 740705 - protein, 201 aa, Homo sapiens; identical to SEQ ID NO: 740693

SEQ ID NO: 740706 - protein, 232 aa, Homo sapiens
VQTEGRDRKGLIIDQVFRMVGCGGFPGPTTDMSYMEYLRNRMCTSVTSDRVAASNIVQMKDDHDKMFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 740707 - protein, 117 aa, Homo sapiens
PSTSPGRTSRHRRAQTGFSAWILGWVAPVSGLAPLCLPAVGPLSVGLNCQGLRPFLFGGMEGASGPISRERAVELLRKCLEELQKRFILNLPTFSVRIIDKNGIHDLDNISFPKQGS

SEQ ID NO: 740708 - protein, 201 aa, Homo sapiens; identical to SEQ ID NO: 740693

SEQ ID NO: 740709 - protein, 201 aa, Homo sapiens; identical to SEQ ID NO: 740693

SEQ ID NO: 740710 - protein, 201 aa, Homo sapiens; identical to SEQ ID NO: 740693

SEQ ID NO: 740711 - protein, 268 aa, Homo sapiens
DELGLRSKQQAAVRGEDGKESWSQCDLVKEARKKEGALNDLVVKLGKRIPGRSKCNLVMKVAGGLAWQPHGGGEQALCERILLLATRVASNIVQMKDDHDKMFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 740712 - protein, 201 aa, Homo sapiens; identical to SEQ ID NO: 740693

SEQ ID NO: 740713 - protein, 183 aa, Homo sapiens
MEYLIGIQGPDYVLVASDRVAASNIVQMKDDHDKMFKMSEKILLLCVGEAGDTVQFAEYIQTANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 740714 - protein, 115 aa, Homo sapiens
MEYLIGIQGPDYVLVASDRVAASNIVQMKDDHDKMFKMSEKILLLCVGEAGDTVQFAEYIQKNVQLYKMRNGYELSPTAAANFTRRNLADCLRSRILAHCNLRLPGPSDPPISAS

SEQ ID NO: 740715 - protein, 704 aa, Homo sapiens
MWKKRGGVHTLLSTAAQDLIHAELKMLFTKCFLSSGFKLGRKMIQKESVREEVGNQNIVETSMMQEPNYQQELSKPQTWKDVIGGSQHSSHEDTNKNINSEQDIVEMVSLAAEESSLMNDLFAQEIEYSPVELESLSNEENIETERWNGRILQMLNRLRVADQGQAAAAATAEALRQAGPEWCEPAGLRRASGLSPRDTAHPTPYSDPQPMAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 740716 - protein, 538 aa, Homo sapiens
MPGSGPSERMTWPGPALSAGPPTRPLSSAPGIPPIPPLTRTHSLMAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 740717 - protein, 663 aa, Homo sapiens
MQSWRRRKSLWLALSASWLLLVLLGGFSLLRLALPPRPRPGASQGWPRWLDAELLQSFSQPGELPEDAVSPPQAPHGGSCNWESCFDTSKCRGDGLKVFVYPAVGTISETHRRILASIEGSRFYTFSPAGACLLLLLSLDAQTGECSSMPLQWNRGRNHLVLRLHPAPCPRTFQLGQAMVAEASPTVDSFRPGFDVALPFLPEAHPLRGGAPGQLRQHSPQPGVALLALEEERGGWRTADTGSSACPWDGRCEQDPGPGQTQRQETLPNATFCLISGHRPEAASRFLQALQAGCIPVLLSPRWELPFSEVIDWTKAAIVADERLPLQVLAALQEMSPARVLALRQQTQFLWDAYFSSVEKVIHTTLEVIQDRIFGTSAHPSLLWNSPPGALLALSTFSTSPQDFPFYYLQQGSRPEGRFSALIWVGPPGQPPLKLIQAVAGSQHCAQILVLWSNERPLPSRWPETAVPLTVIDGHRKVSDRFYPYSTIRTDAILSLDARSSLSTSEVDFAFLVWQSFPERMVGFLTSSHFWDEAHGGWGYTAERTNEFSMVLTTAAFYHRYYHTLFTHSLPKALRTLADEAPTCVDVLMNFIVAAVTKLPPIKAPGGPGPRPKPPAPAPDCINQIAAAFGHMPLLSSRLRLDPVLFKDPVSVQRKKYRSLEKP

SEQ ID NO: 740718 - protein, 156 aa, Homo sapiens
MVGFLTSSHFWDEAHGGWGYTAERTNEFSMVLTTAAFYHRYYHTLFTHSLPKALRTLADEAPTCVDVLMNFIVAAVTKLPPIKVPYGKQRQEAAPLAPGGPGPRPKPPAPAPDCINQIAAAFGHMPLLSSRLRLDPVLFKDPVSVQRKKYRSLEKP

SEQ ID NO: 740719 - protein, 676 aa, Homo sapiens
MQSWRRRKSLWLALSASWLLLVLLGGFSLLRLALPPRPRPGASQGWPRWLDAELLQSFSQPGELPEDAVSPPQAPHGGSCNWESCFDTSKCRGDGLKVFVYPAVGTISETHRRILASIEGSRFYTFSPAGACLLLLLSLDAQTGECSSMPLQWNRGRNHLVLRLHPAPCPRTFQLGQAMVAEASPTVDSFRPGFDVALPFLPEAHPLRGGAPGQLRQHSPQPGVALLALEEERGGWRTADTGSSACPWDGRCEQDPGPGQTQRQETLPNATFCLISGHRPEAASRFLQALQAGCIPVLLSPRWELPFSEVIDWTKAAIVADERLPLQVLAALQEMSPARVLALRQQTQFLWDAYFSSVEKVIHTTLEVIQDRIFGTSAHPSLLWNSPPGALLALSTFSTSPQDFPFYYLQQGSRPEGRFSALIWVGPPGQPPLKLIQAVAGSQHCAQILVLWSNERPLPSRWPETAVPLTVIDGHRKVSDRFYPYSTIRTDAILSLDARSSLSTSEVDFAFLVWQSFPERMVGFLTSSHFWDEAHGGWGYTAERTNEFSMVLTTAAFYHRYYHTLFTHSLPKALRTLADEAPTCVDVLMNFIVAAVTKLPPIKVPYGKQRQEAAPLAPGGPGPRPKPPAPAPDCINQIAAAFGHMPLLSSRLRLDPVLFKDPVSVQRKKYRSLEKP

SEQ ID NO: 740720 - protein, 137 aa, Homo sapiens
MARLPKLAVFDLDYTLWPFWVDTHVDPPFHKSSDGTVRDRRGQDVRLYPEVPEVLKRLQSLGVPGAAASRTSEIEGANQLLELFDLFRYFVHREIYPGSKITHFERLQQKTGIPFSQMIFFDDERRNIVDVSKLGTE

SEQ ID NO: 740721 - protein, 122 aa, Homo sapiens
MARLPKLAVFDLDYTLWPFWVDTHVDPPFHKSSDGTVRDRRGQDVRLYPEVPEVLKRLQSLGVPGAAASRTSEIEGANQLLELFDLFRCYLHSHPEWNESSNSKSRVRDICEGPNWAFEVQP

SEQ ID NO: 740722 - protein, 59 aa, Homo sapiens
MIFFDDERRNIVDVSKLGVTCIHIQNGMNLQTLSQGLETFAKAQTGPLRSSLEESPFEA

SEQ ID NO: 740723 - protein, 176 aa, Homo sapiens
MARLPKLAVFDLDYTLWPFWVDTHVDPPFHKSSDGTVRDRRGQDVRLYPEVPEVLKRLQSLGVPGAAASRTSEIEGANQLLELFDLFRYFVHREIYPGSKITHFERLQQKTGIPFSQMIFFDDERRNIVDVSKLGVTCIHIQNGMNLQTLSQGLETFAKAQTGPLRSSLEESPFEA

SEQ ID NO: 740724 - protein, 176 aa, Homo sapiens
AGPRRPTVSYSSITALMERRVYVRVDPERPESSDGTVRDRRGQDVRLYPEVPEVLKRLQSLGVPGAAASRTSEIEGANQLLELFDLFRYFVHREIYPGSKITHFERLQQKTGIPFSQMIFFDDERRNIVDVSKLGVTCIHIQNGMNLQTLSQGLETFAKAQTGPLRSSLEESPFEA

SEQ ID NO: 740725 - protein, 59 aa, Homo sapiens; identical to SEQ ID NO: 740722

SEQ ID NO: 740726 - protein, 128 aa, Homo sapiens
MRQETAKASFRRESTAPGVFIYENLFFVHFLCNDLLSLRFCLPAILLLGWWFLFSSKFLPPNKYYVKNSYQINENTGKEYIGTFCYICNFLLLKGTEGRPGAVAHAQHFGRLRWEDPLGPGVQGYSEL

SEQ ID NO: 740727 - protein, 485 aa, Homo sapiens
MLERLKAPWSAALQRKYFDLGIWTAPISPMALTMLNGLLIKDSSPPMLLHQVNKTAQLDTFNYQSCFMQSVFDHFPEILFIHRTYNPRGKVLYTFLVDGPRVQLEGHLARAVYFAIPAKEDTEGLAQMFQVFKKFNPAWERVCTILVDPHFLPLPILAMEFPTAEVLLSAFHICKFLQAKFYQLSLERPVERLLLTSLQSTMCSATAGNLRKLYTLLSNCIPPAKLPELHSHWLLNDRIWLAHRWRSRAESSHYFQSLEVTTHILSQFFGTTPSEKQGMASLFRYMQQNSADKANFNQGLCAQNNHAPSDTIPESPKLEQLVESHIQHSLNAICTGPAAQLCLGELAVVQKSTHLIGSGSEKMNIQILEDTHKVQPQPPASCSCYFNQAFHLPCRHILAMLSARRQVLQPDMLPAQWTAGCATSLDSILGSKWSETLDKHLAVTHLTEEVGQLLQHCTKEEFERRYSTLRELADSWIGPYEQVQL

SEQ ID NO: 740728 - protein, 485 aa, Homo sapiens; identical to SEQ ID NO: 740727

SEQ ID NO: 740729 - protein, 236 aa, Homo sapiens
MLERLKAPWSAALQRKYFDLGIWTAPISPMALTMLNGLLIKDSSPPMLLHQVNKTAQLDTFNYQSCFMQSVFDHFPEILFIHRTYNPRGKVLYTFLVDGPRVQLEGHLARAVYFAIPAKEDTEGLAQMFQVFKKFNPAWERVCTILVDPHFLPLPILAMEFPTAEVLLSAFHICKFLQAKFYQLSLERPVERLLLTSLQSTMCSATAGNLRKLYTLLSNCIPPEPGRVRLHLKKIK

SEQ ID NO: 740730 - protein, 485 aa, Homo sapiens; identical to SEQ ID NO: 740727

SEQ ID NO: 740731 - protein, 262 aa, Homo sapiens
MLERLKAPWSAALQRKYFDLGIWTAPISPMALTMLNGLLIKDSSPPMLLHQVNKTAQLDTFNYQSCFMQSVFDHFPEILFIHRTYNPRGKVLYTFLVDGPRVQLEGHLARAVYFAIPAKEDTEGLAQMFQVFKKFNPAWERVCTILVDPHFLPLPILAMEFPTAEVLLSAFHICKFLQAKFYQLSLERPVERLLLTSLQSTMCSATAGNLRKLYTLLSNCIPPAKLPELHSHWLLNDRIWLAHRWRSRAESSHYFQSLEVTT

SEQ ID NO: 740732 - protein, 152 aa, Homo sapiens
MLERLKAPWSAALQRKYFDLGIWTAPISPMALTMLNGLLIKDSSPPMLLHQVNKTAQLDTFNYQSCFMQSVFDHFPEILFIHRTYNPRGKVLYTFLVDGPRVQLEGHLARAVYFAIPAKEDTEGLAQMFQVFKKFNPAWERVCTILVDPHFL

SEQ ID NO: 740733 - protein, 439 aa, Homo sapiens
THGRTHTAAGPGTTLSAAAPEVRGAQPGPLEGAAGRPAPPLEAAGPGAQWATNFRSASPPRQRADSGSARLCAAPDGCDRWPGARAAGTHGPRARVPAPLSPSPRADLGIQRPAARALPARPTAARSVRSLRCASARLPPPGLRPFAALTTPWPGAPTARPVEAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 740734 - protein, 173 aa, Homo sapiens
MAHVPARTSPGPGPQLLLLLLPLFLLLLRDVAGSHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEPPRWPRALEVLCKPRAKNASGRPLPLGPPTRHLST

SEQ ID NO: 740735 - protein, 478 aa, Homo sapiens
MAHVPARTSPGPGPQLLLLLLPLFLLLLRDVAGSHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEPPRWPRALEVLCKPRAKNASGRPLPLGPPTRQHLLFRSLSQNTATQGLLRGAMALAPPPRGLWQAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 740736 - protein, 161 aa, Homo sapiens
MAHVPARTSPGPGPQLLLLLLPLFLLLLRDVAGSHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEAFIHMVCTCSQYWFLFLNIYILF

SEQ ID NO: 740737 - protein, 68 aa, Homo sapiens
GRRAARICTPDASGAACAGPAACGLGDAQTEAAPLPPLHSAAWPVERGFPAQPASGPIPSPLIISVKG

SEQ ID NO: 740738 - protein, 46 aa, Homo sapiens
MALFCNPTSETQFSFLPQSQHAALISQRQPPGALMKSTLWVRHQVP

SEQ ID NO: 740739 - protein, 277 aa, Homo sapiens
MEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSGIEVTLAEGLTSVSQRTQPTPCRRRYL

SEQ ID NO: 740740 - protein, 257 aa, Homo sapiens [sequence omitted]

SEQ ID NO: 740741 - protein, 213 aa, Homo sapiens
MEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKNKGRCCAVSLLILYN

SEQ ID NO: 740742 - protein, 287 aa, Homo sapiens
RPHPRHAPAEPKGARGDGVRVSARLQSCRTSPARGLKTAKPQLWGAGVHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSVSVSTVH

SEQ ID NO: 740743 - protein, 68 aa, Homo sapiens
MMTLCTQKTAPTAKPPTDTELLGRGARGERRVSTPHRASHRAWHLTGTQSQMDADGSQTGHELSRLFS

SEQ ID NO: 740744 - protein, 488 aa, Homo sapiens
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMCDQDQCIQSTKFVLQAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 740745 - protein, 371 aa, Homo sapiens
QSRGPCTCATKEAGVPAEDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMCDQDQCIQSTKFVLQAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 740746 - protein, 356 aa, Homo sapiens [sequence omitted]

SEQ ID NO: 740747 - protein, 365 aa, Homo sapiens
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMVGVGATAPC

SEQ ID NO: 740748 - protein, 69 aa, Homo sapiens
QEAKKKSMSTCVFTFQDQAEAVDYLENLGRPLSGHGDPSDLRGDKVCIFAPKFAKGVARDIFLEEARTK

SEQ ID NO: 740749 - protein, 149 aa, Homo sapiens
MQHSTDTSSADNRDDGNSKETSRRSKSSKQQNESDTAADGQSKRKQTRKRIDQTHAGPGDNDTVRKADQSKKDRATSGHTERRNHSRESGGSDWRRAEEERTAGHNRESEHRRERMNKRQGRREQRRTKTQREETREQQIAREQNKRRR

SEQ ID NO: 740750 - protein, 129 aa, Homo sapiens
MEEATGCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 740751 - protein, 313 aa, Homo sapiens
RDEDLSRGRSPGSCDTDALVEDLLSAAVSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPEGWSPWSEWSKCTDDGAQSRSRHCEELLPGSSACAGNSSQSRPCPYSEIPVILPASSMEEATGCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 740752 - protein, 334 aa, Homo sapiens
RDEDLSRGRSPGSCDTDALVEDLLSAAVSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATGCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 740753 - protein, 150 aa, Homo sapiens
CCCFCSQGGRQESVLFTVALILLPASLPLGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 740754 - protein, 313 aa, Homo sapiens; identical to SEQ ID NO: 740751

SEQ ID NO: 740755 - protein, 116 aa, Homo sapiens
QLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQGL

SEQ ID NO: 740756 - protein, 302 aa, Homo sapiens
QLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLCDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERARG

SEQ ID NO: 740757 - protein, 313 aa, Homo sapiens
QLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLCDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRTRVPRKQALQRLHERKTRIMGVVGRAPTHMGEGRQPPPGASYPTSCHRTKWRSEQKDWKRAERRRSESSRRSRL

SEQ ID NO: 740758 - protein, 73 aa, Homo sapiens
MGREVVLAEPQGPAGPGPAHMHLGRASQRGLMTRAPKRQGQAGVPRREPSCGRSAEPSVPAGSRQRTENAQFR

SEQ ID NO: 740759 - protein, 119 aa, Homo sapiens [sequence omitted]

SEQ ID NO: 740760 - protein, 119 aa, Homo sapiens [sequence omitted]

SEQ ID NO: 740761 - protein, 119 aa, Homo sapiens [sequence omitted]

SEQ ID NO: 740762 - protein, 118 aa, Homo sapiens
PVRASWLLCLPNQAWAMAGAPPPASLPPCSLISDCCASNQRDSVGVGPSEPGAGYILVVRRFLSPSERRSIWVGVTRFSRCRPSPLSLTQKGNSLTPCASQVRQCLALLRLAHGARSH

SEQ ID NO: 740763 - protein, 118 aa, Homo sapiens; identical to SEQ ID NO: 740762

SEQ ID NO: 740764 - protein, 118 aa, Homo sapiens; identical to SEQ ID NO: 740762

SEQ ID NO: 740765 - protein, 273 aa, Homo sapiens
ERVVDMAAIRMGKLTTMPAGLIYASVSVHAAKQEESKKQLVKPEQLPIYTAPPLQSKYVEEQPGHLQMGFASIRTATGCYIGWCKGVYVFVKNGIMDTVQFGKDAYVYLKNPPRDFLPKMGVITVSGLAGLVSARKGSKFKKITYPLGLATLGATVCYPVQSVIIAKVTAKKVYATSQQIFGAVKSLWTKSSKEESLPKPKEKTKLGSSSEIEVPAKTTHVLKHSVPLPTELSSEAKTKSESTSGATQFMPDPKLMDHGQSHPEDIDMYSTRS

SEQ ID NO: 740766 - protein, 690 aa, Homo sapiens
MTDTVFSNSSNRWMYPSDRPLQSKLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 740767 - protein, 227 aa, Homo sapiens
MTDTVFSNSSNRWMYPSDRPLQSKLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGAREDGRAGSQTGRTALLPRDHGLRPGP

SEQ ID NO: 740768 - protein, 690 aa, Homo sapiens; identical to SEQ ID NO: 740766

SEQ ID NO: 740769 - protein, 690 aa, Homo sapiens; identical to SEQ ID NO: 740766

SEQ ID NO: 740770 - protein, 890 aa, Homo sapiens
MEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFTENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 740771 - protein, 890 aa, Homo sapiens; identical to SEQ ID NO: 740770

SEQ ID NO: 740772 - protein, 921 aa, Homo sapiens
SISGPGQEAVPLRPKAEPPEGSGMVWDRQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 740773 - protein, 523 aa, Homo sapiens
MQKPFKLSFEVSSDLAFILIKSNTSWDIYKATYSCGVVLIVLNVDLNVYKIVSLSLLHSSVSASWHAYKHGLLHLLLTHYNAVSVLNYRNSRCYSDVDFLLEYFYVVGTSGGQCLLFYICLLFPVWLLSLKDSQQNKAADQPKLETESVININLNACLAVPCYSPLASELSATGIHLFRKEFCFLYCLISSMTSYCVKKNHFLIFFGGYFPNNQHVNNLLRASSDALHYCYLILLCKLDFRRIDFKTLNQAIIIFKNKTSSIHFVINIDKHCDFFGYDFFIDLNCLNCIYCKIGSDVYFKLISMDFPLEMLVYSVIKYSDTSFISGEYSCIVFALVTCLYKGHPSYILCFLSVFHLRIFPFSLIFFLIFYAGWGGIKPSGQAFCLQVYLKMSYIWSSFSSNSQNRKVEIFLPYIKLFCLAEMPEINLLHLSLNFKSFAMRKKWFFASYGKSILFILNVLTDNGAKAFFPGKKCIMHNCNLSPSFDNTSKHTQLCFTELFLQIIQGGETNLLLVLLMKYRPWNI

SEQ ID NO: 740774 - protein, 921 aa, Homo sapiens; identical to SEQ ID NO: 740772

SEQ ID NO: 740775 - protein, 890 aa, Homo sapiens [sequence omitted]

SEQ ID NO: 740776 - protein, 890 aa, Homo sapiens; identical to SEQ ID NO: 740770

SEQ ID NO: 740777 - protein, 535 aa, Homo sapiens
CGETLRLERKRFLWQHQLLGLLSVYTRPSCGPEALGHLLSRARSPEELSLATQLYAGLVVSLSGLLPLAFRSCLARVHAGTLQPPFTARFLRNLALLVGWEQQGGEGPAALGAHFGESASAHLSDLAPLLLHPEEEVAEAAASLLAICPFPSEALSPSQLLGLVRAGVHRFFASLRLHGPPGVASACQLLTRLSQTSPAGLKAVLQLLVEGALHRGNTELFGGQVDGDNETLSVVSASLASASLLDTNRRHTAAVPGPGGIWSVFHAGVIGRGLKPPKFVQSRNQQEVIYNTQSLLSLLVHCCSAPGGTECGECWGAPILSPEAAKAVAVTLVESVCPDAAGAELAWPPEEHARATVERDLRIGRRFREQPLLFELLKLVAAAPPALCYCSVLLRGLLAALLGHWEASRHPDTTHSPWHLEASCTLVAVMAEGSLLPPALGNMHEVFSQLAPFEVRLLLLSVWGFLREHGPLPQKFIFQSERGRFIRDFSREGGGEGGPHLAVLHSVLHRNIDRLGLFSGRFQAPSPSTLLRQGT

SEQ ID NO: 740778 - protein, 535 aa, Homo sapiens; identical to SEQ ID NO: 740777

SEQ ID NO: 740779 - protein, 504 aa, Homo sapiens
CGETLRLERKRFLWQHQLLGLLSVYTRPSCGPEALGHLLSRARSPEELSLATQLYAGLVVSLSGLLPLAFRSCLARVHAGTLQPPFTARFLRNLALLVGWEQQGGEGPAALGAHFGESASAHLSDLAPLLLHPEEEVAEAAASLLAICPFPSEALSPSQLLGLVRAGVHRFFASLRLHGPPGVASACQLLTRLSQTSPAGLKAVLQLLVEGALHRGNTELFGGQVDGDNETLSVVSASLASASLLDTNRRHTAAVPGPGGIWSVFHAGVIGRGLKPPKFVQSRNQQEVIYNTQSLLSLLVHCCSAPGGTECGECWGAPILSPEAAKAVAVTLVESVCPDAAGAELAWPPEEHARATVERDLRIGRRFREQPLLFELLKLVAAAPPALCYCSVLLRGLLAALLGHWEASRHPDTTHSPWHLEASCTLVAVMAEGSLLPPALGNMHEVFSQLAPFEVRLLLLSVWGFLREHGPLPQKFIFQSERGRFIRDFSREGGGEGLFFFSFR

SEQ ID NO: 740780 - protein, 495 aa, Homo sapiens
CGETLRLERKRFLWQHQLLGLLSVYTRPSCGPEALGHLLSRARSPEELSLATQLYAGLVVSLSGLLPLAFRSCLARVHAGTLQPPFTARFLRNLALLVGWEQQGGEGPAALGAHFGESASAHLSDLAPLLLHPEEEVAEAAASLLAICPFPSEALSPSQLLGLVRAGVHRFFASLRLHGPPGVASACQLLTRLSQTSPAGLKAVLQLLVEGALHRGNTELFGGQVDGDNETLSVVSASLASASLLDTNRRHTAAVPGPGGIWSVFHAGVIGRGLKPPKFVQSRNQQEVIYNTQSLLSLLVHCCSAPGGTECGECWGAPILSPEAAKAVAVTLVESVCPDAAGAELAWPPEEHARATVERDLRIGRRFREQPLLFELLKLVAAAPPALCYCSVLLRGLLAALLGHWEASRHPDTTHSPWHLEASCTLVAVMAEGSLLPPALGNMHEVFSQLAPFEVRLLLLSVWGFLREHGPLPQKFIFQSERGRFIRDFLLRQGT

SEQ ID NO: 740781 - protein, 108 aa, Homo sapiens
DGSRYPDMPTAADVVNALDQQALASILRTYGEEKHAKKIASAIVQARSIYPITRTQQLASIVAGSLINSQQCLREENYIYMCVCINPPDSLRDSFVLEIQDRILPILL

SEQ ID NO: 740782 - protein, 297 aa, Homo sapiens
MSSAHFNRGPAYGLSAEVKNKLAQKYDHQREQELREWIEGVTGRRIGNNFMDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELGEPAHNHHAHNYYNSA

SEQ ID NO: 740783 - protein, 281 aa, Homo sapiens
MLGSQLAQKYDHQREQELREWIEGVTGRRIGNNFMDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELGEPAHNHHAHNYYNSA

SEQ ID NO: 740784 - protein, 297 aa, Homo sapiens
RGGDRPSIHSLSSCSRWWSYFWARLVLTPREQELREWIEGVTGRRIGNNFMDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELGEPAHNHHAHNYYNSA

SEQ ID NO: 740785 - protein, 297 aa, Homo sapiens; identical to SEQ ID NO: 740782

SEQ ID NO: 740786 - protein, 165 aa, Homo sapiens
GEGKAAEVVGGGAPPLWQAPTANGTALEETRVASGASKTCEEGRVCRRNFSRCLCSQRQCRHCPRQSPPASMSSAHFNRGPAYGLSAEVKNKLAQKYDHQREQELREWIEGVTGRRIGNNFMDGLKDGIILCELLLLLAGPSQAQPTPSPCMASSSPCRTQPLQG

SEQ ID NO: 740787 - protein, 140 aa, Homo sapiens
GEGKAAEVVGGGAPPLWQAPTANGTALEETRVASGASKTCEEGRVCRRNFSRCLCSQRQCRHCPRQSPPASMSSAHFNRGPAYGLSAEVKNKLAQKYDHQREQELREWIEGVTGRRIGNNFMDGLKDGIILCDDWHTMWM

SEQ ID NO: 740788 - protein, 161 aa, Homo sapiens
MRELEAKATKDVERNLSRDLVQEEEQLMEEKKKKKDDKKKKEAAQKKATEQKIKVPEQIKPSVSQPQPANSNNGTSTATSTNNNAKRATANNQQPQQQQQQRLGPLPAALRRALSSRASFAAPHLLVHFTHMRELEAKATKDVERNLSREFSARRRTVDGK

SEQ ID NO: 740789 - protein, 446 aa, Homo sapiens
ALRRSRLGLGSGSGMSALCDPPGAPGPPGPAPATHGPAPLSAQELSQEIKAFLTGVDPILGHQLSAREHARCGLLLLRSLPPARAAVLDHLRGVFDESVRAHLAALDETPVAGPPHLRPPPPSHVPAGGPGLEDVVQEVQQVLSEFIRANPKAWAPVISAWSIDLMGQLSSTYSGQHQRVPHATGALNELLQLWMGCRATRTLMDIYVQCLSALIGSCPDACVDALLDTSVQHSPHFDWVVAHIGSSFPGTIISRVLSCGLKDFCVHGGAGGGAGSSGGSSSQTPSTDPFPGSPAIPAEKRVPKIASVVGILGHLASRHGDSIRRELLRMFHDSLAGGSGGRSGDPSLQATVPFLLQLAVMSPALLGTVSGELVDCLKPPAVLSQLQQHLQGFPREELDNMLNLAVHLVSQASGAGAYRLLQFLVDTAMPASVITTQGLAVPDHRA

SEQ ID NO: 740790 - protein, 41 aa, Homo sapiens
MRVSGPTWLPWMKPLWLVHLTSVHLPFCRLLRQPVSTRPRI

SEQ ID NO: 740791 - protein, 281 aa, Homo sapiens
MGQLSSTYSGQHQRVPHATGALNELLQLWMGCRATRTLMDIYVQCLSALIGSCPDACVDALLDTSVQHSPHFDWVVAHIGSSFPGTIISRVLSCGLKDFCVHGGAGGGAGSSGGSSSQTPSTDPFPGSPAIPAEKRVPKIASVVGILGHLASRHGDSIRRELLRMFHDSLAGGSGGRSGDPSLQATVPFLLQLAVMSPALLGTVSGELVDCLKPPAVLSQLQQHLQGFPREELDNMLNLAVHLVSQASGAGAYRLLQFLVDTAMPASVITTQGLAVPDHRA

SEQ ID NO: 740792 - protein, 142 aa, Homo sapiens [sequence omitted]

SEQ ID NO: 740793 - protein, 655 aa, Homo sapiens
MDHTGAIDTEDEVGPLAHLAPSPQSEAVAHEFQELSLQSSQNLPPLNERKNVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFAQCPHAEFLKTPPTADQPPPRPAAPVLPTNTVSSAKPGPALVKQSHPKNPNDKHRSKKCKDPKPRVKKLKYHQYIPPDQKGEKNEPQMDSNYARLLQQQQLFLQLQILSQQKQHYNYQTILPAPFKPLNDKNSNSGNSALNNATPNTPRQNTSTPVRKPGPLPSSLDDLKVSELKTELKLRGLPVSGTKPDLIERLKPYQEVNSSGLAAGGIVAVSSSAIVTSNPEVTVALPVTTLHNTVTSSVSTLKAELPPTGTSNATRVENVHSPLPISPSPSEQSSLSTDDTNMADTFTEIMTMMSPSQFLSSSPLRMTNNEDSLSPTSSTLSNLELDAAEKDRKLQEKEKQIEELKRKLEQEQKLVEVLKMQLEVEKRGQQQRPLEAQPSAPGHSVKSDQKHGSLGSSIKDEASLPDCSSSRQPIPVA

SEQ ID NO: 740794 - protein, 404 aa, Homo sapiens
MDHTGAIDTEDEVGPLAHLAPSPQSEAVAHEFQELSLQSSQNLPPLNERKNVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFAQCPHAEFLKTPPTADQPPPRPAAPVLPTNTVSSAKPGPALVKQSHPKNPNDKHRSKKCKDPKPRVKKLKYHQYIPPDQKGEKNEPQMDSNYARLLLCHLLAQPTPGPGPRLQQMWLTQCRHMPGHAGWLLSWASAPSHQAVGLRPTRKVAVQPELLKRNPRSWLERDTPDY

SEQ ID NO: 740795 - protein, 238 aa, Homo sapiens
MDHTGAIDTEDEVGPLAHLAPSPQSEAVAHEFQELSLQSSQNLPPLNERKNVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFASVSPR

SEQ ID NO: 740796 - protein, 670 aa, Homo sapiens
ANASNSPSSLRLLNEPQKRDCGSTGAGTDNDPNIYFLIQKMFYMLNTLTSNMSQLHSKVDLLSLEVSRIKKQVSPTEMVAKFQPPPEYQLTAAELKQIVDQSLSGGDLACRLLVQLFPELFSDVDFSRGCSACGFAAKRKLESLHLQLIRNYVEVYYPSVKDTAVWQAECLPQLNDFFSRFWAQREMEDSQPSGQVASFFEAEQVDPGHFLDNKDQEEALSLDRSSTIASDHVVDTQDLTEFLDEASSPGEFAVFLLHRLFPELFDHRKLGEQYSCYGDGGKQELDPQRLQIIRNYTEIYFPDMQEEEAWLQQCAQRINDELEGLGLDAGSEGDPPRDDCYDSSSLPDDISVVKVEDSFEGERPGRRSKKIWLVPIDFDKLEIPQPDFEVPGADCLLSKEQLRSIYESSLSIGNFASRLLVHLFPELFTHENLRKQYNCSGSLGKKQLDPSRIKLIRHYVQLLYPRAKNDRVWTLEFVGKLDERCRRRDTEQRRSYQQQRKVHVPGPECRDLTSYAINPERFREEFEGPPLPPERSSKDFCKIPLDELVVPSPDFPVPSPYLLSDKEVREIVQQSLSVGNFAARLLVRLFPELFTAENLRLQYNHSGACNKKQLDPTRLRLIRHYVEAVYPVEKMEEVWHYECIPSIDERCRRPNRKKCDILKKAKKVEK

SEQ ID NO: 740797 - protein, 448 aa, Homo sapiens
MTAALHSPVLRWDTQDLTEFLDEASSPGEFAVFLLHRLFPELFDHRKLGEQYSCYGDGGKQELDPQRLQIIRNYTEIYFPDMQEEEAWLQQCAQRINDELEGLGLDAGSEGDPPRDDCYDSSSLPDDISVVKVEDSFEGERPGRRSKKIWLVPIDFDKLEIPQPDFEVPGADCLLSKEQLRSIYESSLSIGNFASRLLVHLFPELFTHENLRKQYNCSGSLGKKQLDPSRIKLIRHYVQLLYPRAKNDRVWTLEFVGKLDERCRRRDTEQRRSYQQQRKVHVPGPECRDLTSYAINPERFREEFEGPPLPPERSSKDFCKIPLDELVVPSPDFPVPSPYLLSDKEVREIVQQSLSVGNFAARLLVRLFPELFTAENLRLQYNHSGACNKKQLDPTRLRLIRHYVEAVYPVEKMEEVWHYECIPSIDERCRRPNRKKCDILKKAKKVEK

SEQ ID NO: 740798 - protein, 448 aa, Homo sapiens; identical to SEQ ID NO: 740797

SEQ ID NO: 740799 - protein, 448 aa, Homo sapiens; identical to SEQ ID NO: 740797

SEQ ID NO: 740800 - protein, 304 aa, Homo sapiens
CPECGKAFSEKSRLRKHQRTHTGEKPYKCDGCDKAFSAKSGLRIHQRTHTGEKPFECHECGKSFNYKSILIVHQRTHTGEKPFECNECGKSFSHMSGLRNHRRTHTGERPYKCDECGKAFKLKSGLRKHHRTHTGEKPYKCNQCGKAFGQKSQLRGHHRIHTGEKPYKCNHCGEAFSQKSNLRVHHRTHTGEKPYQCEECGKTFRQKSNLRGHQRTHTGEKPYECNECGKAFSEKSVLRKHQRTHTGEKPYNCNQCGEAFSQKSNLRVHQRTHTGEKPYKCDKCGRTFSQKSSLREHQKAHPGD

SEQ ID NO: 740801 - protein, 75 aa, Homo sapiens
DPDDIWQLSSSLKGFDDKYTLKLTFISGRTKQQREAEFTKSIAKFFDHSGTLVMDAYEPEISRLHDSLAIERKIK

SEQ ID NO: 740802 - protein, 75 aa, Homo sapiens; identical to SEQ ID NO: 740801

SEQ ID NO: 740803 - protein, 38 aa, Homo sapiens
MEEVRGITPVFPNNKPTHDRQQLQGPALPSPLGTEQFP

SEQ ID NO: 740804 - protein, 157 aa, Homo sapiens
TAVGKLLLGILADFKWINTLYLYVATLIIMGLALCAIPFAKSYVTLALLSGILGFLTGNWSIFPYVTTKTVGIEKLAHAYGILMFFAGLGNSLGPPIVGWFYDWTQTYDIAFYFSGFCVLLGGFILLLAALPSWDTCNKQLPKPAPTTFLYKVASNV

SEQ ID NO: 740805 - protein, 147 aa, Homo sapiens
MELKKSPDGGWGWVIVFVSFLTQFLCYGSPLAVGVLYIEWLDAFGEGKGKTAWVGSLASGVGLLASPVCSLCVSSFGARPVTIFSGFMVAGGLMLSSFAPNIYFLFFSYGIVVGLGCGLLYTATVTITCQYFDDRRGLALGLISTDF

SEQ ID NO: 740806 - protein, 173 aa, Homo sapiens
PSPNHPRSHNRFRLAGVPRKERQGRKRQQGKPRGGEGEREGGAQRRGPAPQLHVAAAAAGLWGQRAAAPGAARSGTDCLILRQGPGPQLARINSRPAGPELQGRAAAAIPTTPPARPHGALSRVLSTGGPAEAGTQVTCSGFSSAQRLSRELITTNKLGCQKQINALPCFLGA

SEQ ID NO: 740807 - protein, 142 aa, Homo sapiens
PSPNHPRSHNRFRLAGVPRKERQGRKRQQGKPRGGEGEREGGAQRRGPAPQLHVAAAAAGLWGQRAAAPGAARSGTDCLILRQGPGPQLARINSRPAGPELQGRAAAAIPTTPPARPHGALSRVLSTGGPAEAGTQLLESCT

SEQ ID NO: 740808 - protein, 143 aa, Homo sapiens
PSPNHPRSHNRFRLAGVPRKERQGRKRQQGKPRGGEGEREGGAQRRGPAPQLHVAAAAAGLWGQRAAAPGAARSGTDCLILRQGPGPQLARINSRPAGPELQGRAAAAIPTTPPARPHGALSRVLSTGGPAEAGTQDLQRNAS

SEQ ID NO: 740809 - protein, 143 aa, Homo sapiens; identical to SEQ ID NO: 740808

SEQ ID NO: 740810 - protein, 142 aa, Homo sapiens; identical to SEQ ID NO: 740807

SEQ ID NO: 740811 - protein, 122 aa, Homo sapiens
SLPLPAPRDHLHLWLVAPFAICKGSSVAASTFLSLLPLSRCPLLALYLLPSSYEDPCDDMGPPRLSRIISHFRTLNSVTSAKSLLPCKVACSQALGVRMSTSLGDYSSAYHTAHNKIHGQRG

SEQ ID NO: 740812 - protein, 257 aa, Homo sapiens
CWPGERLAAGLSRPSLQGSGSPPPVFSALFLVMAALSKSIPHNCYEIGHTWHPSCRVSFLQITGGALEESLKIYAPLYLIAAILRKRKLDYYLHKLLPEILQSASFLTANGALYMAFFCILRLVLIITIEATETLFRMGVARGTITTLRNGEVLLFCITAAMYMFFFRCKDGLKGFTFSALRFIVGKEEIPTHSFSPEAAYAKVEQKREQHEEKPRRMNMIGLVRKFVDSICKHGPRHRCCKHYEDNCISYCIKVSI

SEQ ID NO: 740813 - protein, 373 aa, Homo sapiens
AGRARGWRLGSRAPPCRAQALPLLSSPRCSSSWRPSASPSLITAMRSATETLFRMGVARGTITTLRNGEVLLFCITAAMYMFFFRCKDGLKGFTFSALRFIVGKEEIPTHSFSPEAAYAKVEQKREQHEEKPRRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 740814 - protein, 468 aa, Homo sapiens
CWPGERLAAGLSRPSLQGSGSPPPVFSALFLVMAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLVLLFCITAAMYMFFFRCKDGLKGFTFSALRFIVGKEEIPTHSFSPEAAYAKVEQKREQHEEKPRRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 740815 - protein, 490 aa, Homo sapiens
CWPGERLAAGLSRPSLQGSGSPPPVFSALFLVMAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLATETLFRMGVARGTITTLRNGEVLLFCITAAMYMFFFRCKDGLKGFTFSALRFIVGKEEIPTHSFSPEAAYAKVEQKREQHEEKPRRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 740816 - protein, 373 aa, Homo sapiens; identical to SEQ ID NO: 740813

SEQ ID NO: 740817 - protein, 490 aa, Homo sapiens; identical to SEQ ID NO: 740815

SEQ ID NO: 740818 - protein, 490 aa, Homo sapiens; identical to SEQ ID NO: 740815

SEQ ID NO: 740819 - protein, 423 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKIGLPIRLVVAVNRNDIIHRTVQQGDFSLSEAVKSTLASAMDIQVPYNMERVFWLLSGSDSQVTRALMEQFERTQSVNLPKELHSKLSEAVTSVSVSDEAITQTMGRCWDENQYLLCPHSAVAVNYHYQQIDRQQPSTPRCCLAPASAAKFPEAVLAAGLTPETPAEIVALEHKETRCTLMRRGDNWMLMLRDTIEDLSRQWRSHALNTSQ

SEQ ID NO: 740820 - protein, 423 aa, Homo sapiens; identical to SEQ ID NO: 740819

SEQ ID NO: 740821 - protein, 484 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKLSEAVTSVSVSDEAITQTMGRCWDENQYLLCPHSAVAVNYHYQQIDRQQPSTPRCCLAPASAAKFPEAVLAAGLTPETPAEIVALEHKETRCTLMRRGDNWMLMLRDTIEDLSRQWRSHALNTSQ

SEQ ID NO: 740822 - protein, 484 aa, Homo sapiens; identical to SEQ ID NO: 740821

SEQ ID NO: 740823 - protein, 384 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKHSPVLPRPCLCSQVPGSCPGCWPDP

SEQ ID NO: 740824 - protein, 377 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKGPSSSPSSGRDRTTKKWL

SEQ ID NO: 740825 - protein, 491 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKWERQDYEKMAVMECDGCCVELCLGNCGPRRGSVTDIPGQPWSEVVAELASNQEEQFASTPRCCLAPASAAKFPEAVLAAGLTPETPAEIVALEHKETRCTLMRRGDNWMLMLRDTIEDLSRQWRSHALNTSQ

SEQ ID NO: 740826 - protein, 420 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKFPEAVLAAGLTPETPAEIVALEHKETRCTLMRRGDNWMLMLRDTIEDLSRQWRSHALNTSQ

SEQ ID NO: 740827 - protein, 461 aa, Homo sapiens
SHCEAENPSSGPDRKPHRTVRDADSGVRTFAARAALLRTGPRAPRPAPRAPHLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKLSEAVTSVSVSDEAITQTMGRCWDENQYLLCPHSAVAVNYHYQQIDRQQPSTPRCCLAPASAAKFPEAVLAAGLTPETPAEIVALEHKETRCTLMRRGDNWMLMLRDTIEDLSRQWRSHALNTSQ

SEQ ID NO: 740828 - protein, 484 aa, Homo sapiens; identical to SEQ ID NO: 740821

SEQ ID NO: 740829 - protein, 425 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKLSEAVTSVSVSDEAITQTMGRCWDENQYLLCPHSAVAVNYHYQQIDRQQPSTPRCCLAPASAAKAE

SEQ ID NO: 740830 - protein, 392 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKSVTTHTPQRKERVQPHSRLGVWKSGQGKRTPVS

SEQ ID NO: 740831 - protein, 362 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKSSV

SEQ ID NO: 740832 - protein, 369 aa, Homo sapiens
MWYVSTRGVAPRVNFEGALFSGYAPDGGLFMPEELPQLDRETLCQWSTLSYPGLVKELCALFIGSELLPKDELNDLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKESNWEGLFLF

SEQ ID NO: 740833 - protein, 339 aa, Homo sapiens
SHCEAENPSSGPDRKPHRTVRDADSGVRTFAARAALLRTGPRAPRPAPRAPHLIDRAFSRFRHREVVHLSRLRNGLNVLELWHGVTYAFKDLSLSCTTQFLQYFLEKREKHVTVVVGTSGDTGSAAIESVQGAKNMDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKSSV

SEQ ID NO: 740834 - protein, 397 aa, Homo sapiens
PPFPVARAVPRYARREPGRAAKMSQPKKRKLESGGGGEGGEGTEEEDGAEREAALERPRRTKRERDQLYYECYSDVSVHEEMIADRVRTDAYRLGILRNWAALRGKTVLDVGAGTGILSIFCAQAGARRVYAVEASAIWQQAREVVRFNGLEDRVHVLPGPVETVELPEQVDAIVSEWMGYGLLHESMLSSVLHARTKWLKEGGLLLPASAELFIAPISDQMLEWRLGFWSQVKQHYGVDMSCLEGFATRCLMGHSEIVVQGLSGEDVLARPQRFAQLELSRAGLEQELEAGVGGRFRCSCYGSAPMHGFAIWFQVTFPGGESEKPLVLSTSPFHPATHWKQALLYLNEPVQVEQDTDVSGEITLLPSRDNPRRLRVLLRYKVGDQEEKTKDFAMED

SEQ ID NO: 740835 - protein, 397 aa, Homo sapiens; identical to SEQ ID NO: 740834

SEQ ID NO: 740836 - protein, 397 aa, Homo sapiens; identical to SEQ ID NO: 740834

SEQ ID NO: 740837 - protein, 314 aa, Homo sapiens
PPFPVARAVPRYARREPGRAAKMSQPKKRKLESGGGGEGGEGTEEEDGAEREAALERPRRTKRERDQLYYECYSDVSVHEEMIADRVRTDAYRLGILRNWAALRGKTVLDVGAGTGILSIFCAQAGARRVYAVEASAIWQQAREVVRFNGLEDRVHVLPGPVETVELPEQVDAIVSEWMGYGLLHESMLSSVLHARTKWLKEGGLLLPASAELFIAPISDQMLEWRLGFWSQVTFPGGESEKPLVLSTSPFHPATHWKQALLYLNEPVQVEQDTDVSGEITLLPSRDNPRRLRVLLRYKVGDQEEKTKDFAMED

SEQ ID NO: 740838 - protein, 397 aa, Homo sapiens; identical to SEQ ID NO: 740834

SEQ ID NO: 740839 - protein, 112 aa, Homo sapiens [sequence omitted]

SEQ ID NO: 740840 - protein, 447 aa, Homo sapiens
TQRLWSSSCWEAAPGPSTCAAAMASSIICQEHCQISGQAKIDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLANTCWNGCSTPDAESSLDEAVRVPSSSASENAIGDPYKTHISSAALSLNSLHTVRYYSKVTPSYDATAVTNQNISIHLPSAMPPVSKLLPRHCTSGLGQTCTTHPNCLQQFWAY

SEQ ID NO: 740841 - protein, 107 aa, Homo sapiens [sequence omitted]

SEQ ID NO: 740842 - protein, 359 aa, Homo sapiens
MVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLANTCWNGCSTPDAESSLDEAVRVPSSSASENAIGDPYKTHISSAALSLNSLHTVRYYSKVTPSYDATAVTNQNISIHLPSAMPPVSKLLPRHCTSGLGQTCTTHPNCLQQFWAY

SEQ ID NO: 740843 - protein, 359 aa, Homo sapiens; identical to SEQ ID NO: 740842

SEQ ID NO: 740844 - protein, 359 aa, Homo sapiens; identical to SEQ ID NO: 740842

SEQ ID NO: 740845 - protein, 623 aa, Homo sapiens
MKEERNYNFDGVSTNRLKQQLLEEVRKKDAVQLSIFELRHKITELEAKLNTDNEGSEWKTRYETQLELNDELEKQIVYLKEKVEKIHGNSSDRLSSIRVYERMPVKAMRFAVQGWCSGCIMPSGIQASPKFLLCHPFESLNTLLKQLEEEKRTLESQVKYYALKLEQESKAYQKINNERRTYLAEMSQGSGLHQVSKRQQVDQLPRMQENLVKTQKYDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLANTCWNGCSTPDAESSLDEAVRVPSSSASENAIGDPYKTHISSAALSLNSLHTVRYYSKVTPSYDATAVTNQNISIHLPSAMPPVSKLLPRHCTSGLGQTCTTHPNCLQQFWAY

SEQ ID NO: 740846 - protein, 139 aa, Homo sapiens [sequence omitted]

SEQ ID NO: 740847 - protein, 161 aa, Homo sapiens [sequence omitted]

SEQ ID NO: 740848 - protein, 187 aa, Homo sapiens
GRLVVVEDLHSGAQQHWSGHSAEISTLALSHSAQVLASASGRSSTTAHCQIRVWDVSGGLCQHLIFPHSTTVLALAFSPDDRLLVTLGDHDGRTLALWGTATYDLVSSTRLPEPVHGVAFNPWDAGELTCVGQGTVTFWLLQQRGADISLQVRREPVPEAVGAGELTSLCYGAPPLLYCGTSSGQVC

SEQ ID NO: 740849 - protein, 67 aa, Homo sapiens
PMTGIHRVPSLFANEEHEAREVKLPAETSQLRFPSQDLIPRLPHLKLPCTAHGGQHLLEAVHQETGT

SEQ ID NO: 740850 - protein, 264 aa, Homo sapiens
GEVVMAAPEAEVLSSAAVPDLEWYEKSEETHASQIELLETSSTQEPLNASEAFCPRDCMVPVVFPGPVSQEGCCQFTCELLKHIMYQRQQLPLPYEQLKHFYRKPSPQAEEMLKKKPRATTEVSSRKCQQALAELESVLSHLEDFFARTLVPGVDDSPWGHALGPKEFYDLDVSLLAPYSVDQSLSTDSLFAAGSSEAYHGLMPLEKLQGSSIMGTVVMAQEHRKCGEDWFQTKLNIEGQAGHKLTGTRHGGDFHRTTLGKTHI

SEQ ID NO: 740851 - protein, 305 aa, Homo sapiens
LLMFDTLVEDVNICLQACSSLHALSSSLPDDLLQRCVDVCRVQLVHRGTCIRQAFGKLLKSIPLGVFLSDNNHTEIQEISLALRSHMSKAPSNTFHPQDFSDVISFILYGNSHRTGKDNWLERLFYSCQRLDKRDQSTIPRNLLKTDAILWQWAIWEAAQFTVLSKLRTPLGRAQDTFQTIEGIIRSLAGHTLNPDQDVSQWTTADSDEGHGNNQLRLVLLLQYLENLEKLMYNAYEGCANALTSPPKVIRTFLYTNRQTCQDWLTRIRLSIMRVGLLAGQPAVTVRHGFDLLTEMKTTSLSQGK

SEQ ID NO: 740852 - protein, 249 aa, Homo sapiens
MSSFLINSNYVDPKFPPCEEYSQSDYLPSDHSPGYYAGGQRRESSFQPEAGFGRRAACTVQRYAACRDPGPPPPPPPPPPPPPPPGLSPRAPAPPPAGALLPEPGQRCEAVSSSPPPPPCAQNPLHPSPSHSACKEPVVYPWMRKVHVSTVNPNYAGGEPKRSRTAYTRQQVLELEKEFHYNRYLTRRRRVEIAHALCLSERQIKIWFQNRRMKWKKDHKLPNTKIRSGGAAGSAGGPPGRPNGGPRAL

SEQ ID NO: 740853 - protein, 249 aa, Homo sapiens; identical to SEQ ID NO: 740852

SEQ ID NO: 740854 - protein, 79 aa, Homo sapiens
HLIMLEKNLGLNPGKVSLQGQGDLLKNAKNEAIENMKQIQLACLSCGLSKAPSSSAEAKSKRSLEAIEEKESSEENGKL

SEQ ID NO: 740855 - protein, 997 aa, Homo sapiens
MPSEKKISSANDCISFMQAGCELKKVRPNSRIYNRFFTLDTDLQALRWEPSKKDLEKAKLDISAIKEIRLGKNTETFTNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAEMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEKESSEENGKL

SEQ ID NO: 740856 - protein, 497 aa, Homo sapiens
DSRGSHECLLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 740857 - protein, 441 aa, Homo sapiens
QKQLGRTKRARFGNRLEIPHARLPPLPRPELPLPLPFLLPASQKLREGPERRWGGRPYASSGREKAHPLPRPRKPPAFGAAQSHGILLAGDALGAAFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITW

SEQ ID NO: 740858 - protein, 592 aa, Homo sapiens
QKQLGRTKRARFGNRLEIPHARLPPLPRPELPLPLPFLLPASQKLREGPERRWGGRPYASSGREKAHPLPRPRKPPAFGAAQSHGILLAGDALGAAFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 740859 - protein, 489 aa, Homo sapiens
MWGGGLDLCPMPGQLKFPPCLSRCLLWEPPSLYLTQPTSSLAEPQALICMTSSSSGLFIQDDNMEKLEEIIEKYPRAFPFWIGPFQAFFCIYDPDYAKTLLSRTDPKSQYLQKFSPPLLVTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 740860 - protein, 191 aa, Homo sapiens
LVRSELGSWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 740861 - protein, 327 aa, Homo sapiens
CGAAAARRWGASVCGVRARARARARARAGCEPGGGGGDGDGGGMAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 740862 - protein, 303 aa, Homo sapiens
CGAAAARRWGASVCGVRARARARARARAGCEPGGGGGDGDGGGMAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRAHCVFARKIFLSW

SEQ ID NO: 740863 - protein, 259 aa, Homo sapiens
CGAAAARRWGASVCGAGRGRGRGRGRVRAASREAAAATATAAAWRRARPRPPAPRGSSRASTSSSMACGCRPSAAGRWRRSPTSRCGPATCGSSPTPSPELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRAHCVFARKIFLSW

SEQ ID NO: 740864 - protein, 214 aa, Homo sapiens
CGAAAARRWGASVCGVRARARARARARAGCEPGGGGGDGDGGGMAESEAETPSTPGEFESKYFEFHGVRLPPFCRGKMEEIANFPVRPSDVWIVTYPKSVGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 740865 - protein, 327 aa, Homo sapiens; identical to SEQ ID NO: 740861

SEQ ID NO: 740866 - protein, 332 aa, Homo sapiens
CGAAAARRWGASVCGVRARARARARARAGCEPGGGGGDGDGGGMAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGREELGCGDQGHQRAFGKGTACGGWLTFSSMVLLLGAPPPAEPC

SEQ ID NO: 740867 - protein, 102 aa, Homo sapiens
CLNHYCYWNCLSHLGIVVWQSIGLYHHRAQSFCLQSFLPSWVQNLKMIVVIAKIIVAFTTSKIASIITKSIIAIPTATISITTTMAATKATTITELDDCICD

SEQ ID NO: 740868 - protein, 102 aa, Homo sapiens
CLSVGSEKSRCVKLFVSVCVCDCRCTCVCKCLRMCLSFTYHFWASSHLPSESVSSKTPSLPSATQRFYLYYGLCNLSNKHRTLAPGGVNLDSLAWSIIKLLS

SEQ ID NO: 740869 - protein, 139 aa, Homo sapiens
MKSIMYSISPANSEEGQELYVCTVKDDVNLDTVLLLPFLKEIAVSQLDQLSPEEQLLVKCAAIIGHSFHIDLLQHLLPGWDKNKLLQVLRALVDIHVLCWSDKSQELPAEPILMPSSIDIIDGTKEKKTKLDGRYDERR

SEQ ID NO: 740870 - protein, 249 aa, Homo sapiens
MKSIMYSISPANSEEGQELYVCTVKDDVNLDTVLLLPFLKEIAVSQLDQLSPEEQLLVKCAAIIGHSFHIDLLQHLLPGWDKNKLLQVLRALVDIHVLCWSDKSQELPAEPILMPSSIDIIDGTKEKKTKLDGGSASLLRLQEELSLPQTEVLEFGVPLLRAAAWELWPKEQQIALHLECACFLQVLACRCGSCHGGDFVPFHHFAVCSTKNSKGTSRFCTYRDTGSVLTQVITEKLQLPSPQEQRKSS

SEQ ID NO: 740871 - protein, 151 aa, Homo sapiens
TEPGEACGGRTSRTASLVSGLLNELYSCTEEEEAAGGGRGAEGRRRRRDSLDSSTEASGSDVVLGGRSGAGDSRVLQELQERPSQRHQMLYLRQKGEGRAQQGPGGFLEPGCPRRLCPRSSAHLGCSAERSDTVSLDLTVVPTVAQIYVHT

SEQ ID NO: 740872 - protein, 867 aa, Homo sapiens
TEPGEACGGRTSRTASLVSGLLNELYSCTEEEEAAGGGRGAEGRRRRRDSLDSSTEASGSDVVLGGRSGAGDSRVLQELQERPSQRHQMLYLRQKDANELKTILRELKYRIGIQSAKLLRHLKQKDRLLHKVQRNCDIVTACLQAVSQKRTWQNSSSGVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSTRRTIEGQSPEPVFGDADVDVSAVQAKLGALELNQRDAAAETELRVHPPCQRHCPEPPSAPEENKATSKAPQGSNSKTPIFSPFPSVKPLRKSATARNLGLYGPTERTPTVHFPQMSRSFSKPGGGNSGTKKR

SEQ ID NO: 740873 - protein, 867 aa, Homo sapiens; identical to SEQ ID NO: 740872

SEQ ID NO: 740874 - protein, 860 aa, Homo sapiens
TEPGEACGGRTSRTASLVSGLLNELYSCTEEEEAAGGGRGAEGRRRRRDSLDSSTEASGSDVVLGGRSGAGDSRVLQELQERPSQRHQMLYLRQKDANELKTILRELKYRIGIQSAKLLRHLKQKDRLLHKVQRNCDIVTACLQAVSQKRRVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSTRRTIEGQSPEPVFGDADVDVSAVQAKLGALELNQRDAAAETELRVHPPCQRHCPEPPSAPEENKATSKAPQGSNSKTPIFSPFPSVKPLRKSATARNLGLYGPTERTPTVHFPQMSRSFSKPGGGNSGTKKR

SEQ ID NO: 740875 - protein, 199 aa, Homo sapiens
MPEQSNDYRVAVFGAGGVGKSSLVLRFVKGTFRESYIPTVEDTYRQVISCDKSICTLQITDTTGSHQFPAMQRLSISKGHAFILVYSITSRQSLEELKPIYEQICEIKGDVESIPIMLVGNKCDESPSREVQSSEAEALARTWKCAFMETSAKLNHNVKELFQELLNLEKRRTVSLQIDGKKSKQQKRKEKLKGKCVIM

SEQ ID NO: 740876 - protein, 199 aa, Homo sapiens; identical to SEQ ID NO: 740875

SEQ ID NO: 740877 - protein, 876 aa, Homo sapiens
QGDSNPPRDPGVEMTVFRKVSSTPPVRCSSQHSVFGFNQVSELLPRMEDSGPLRDIKELVREQGSNNVIVTSADREMLKLSSQEKLIGDLPQTPPGAVPDPSLASTDSSEPSPLAGDGAPWSGSSMADTPMSPLLKGSLSQELSKSFLTLTRPDRALVRTSSRREQRRGAGGYQPLDRRGSGEPTPQKAGSSDSCFSGTDRETLSSFKSEKTNSTHLDSPPGGPAPEGSDTDPPSEAELPASPDAGVPSDDTLRSFDTVIGAGTPPGLAEPLLVVRPKDLALLRPSKRQPPLRRHSPPGRAPRRPLLEGGGFFEDEDTSEGSELSPASSLRSQRRYSTDSSSSTSCYSPESSRGAAGGPRKRRAPHGAEEGTAVPPKRPYGTQRTPSTASAKTHARVLSMDGAGGDVLRPPLAGCKAELEAQVGVEQAASEPVVLPAEARRGPAANQPGWRGELQEEGAVGGAAEETGRRDRSSSVRRTQAIRRRHNAGSNPTPPASVMGSPPSSLQEAQRGRAASHSRALTLPSALHFASSLLLTRAGANVHEACTFDDTSEGAVHYFYDESGVRRSYTFGLAGGGYENPVGQQGEQTANGAWDRHSHSSSFHSADVPEATGGLNLLQPRPVVLQGMQVRRVPLEIPEEQTLMEEAPPRAQHSYKYWLLPGRWTSVRYERLALLALLDRTRGVLENIFGVGLSSLVAFLGYLLLLKGFFTDIWVFQFCLVIASCQYSLLKSVQPDAASPMHGHNWVIAYSRPVYFCICCLLIWLLDALGSAQPFPPVSLYGLTLFSASFFFCARDVATVFTLCFPFVFLLGLLPQVNTCPRPRSPPEALPCLHICFALTQFGNSNCPAEVHSPDPFPTLVRVAGFSKPLSGISLC

SEQ ID NO: 740878 - protein, 677 aa, Homo sapiens
QGDSNPPRDPGVEMTVFRKVSSTPPVRCSSQHSVFGFNQVSELLPRMEDSGPLRDIKELVREQGSNNVIVTSADREMLKLSSQEKLIGDLPQTPPGAVPDPSLASTDSSEPSPLAGDGAPWSGSSMADTPMSPLLKGSLSQELSKSFLTLTRPDRALVRTSSRREQRRGAGGYQPLDRRGSGEPTPQKAGSSDSCFSGTDRETLSSFKSEKTNSTHLDSPPGGPAPEGSDTDPPSEAELPASPDAGVPSDDTLRSFDTVIGAGTPPGLAEPLLVVRPKDLALLRPSKRQPPLRRHSPPGRAPRRPLLEGGGFFEDEDTSEGSELSPASSLRSQRRYSTDSSSSTSCYSPESSRGAAGGPRKRRAPHGAEEGTAVPPKRPYGTQRTPSTASAKTHARVLSMDGAGGDVLRPPLAGCKAELEAQVGVEQAASEPVVLPAEARRGPAANQPGWRGELQEEGAVGGAAEETGRRDRSSSVRRTQAIRRRHNAGSNPTPPASVMGSPPSSLQEAQRGRAASHSRALTLPSALHFASSLLLTRAGANVHEACTFDDTSEGAVHYFYDESGVRRSYTFGLAGGGYENPVGQQGEQTANGAWDRHSHSSSFHSADVPEATGGLNLLQPRPVVLQGMQVRRVPLEIPEVRSSRGRAVPVGRDGAGRSLSPACIESLPRCPRRDGQC

SEQ ID NO: 740879 - protein, 584 aa, Homo sapiens
QGDSNPPRDPGVEMTVFRKVSSTPPVRCSSQHSVFGFNQVSELLPRMEDSGPLRDIKELVREQGSNNVIVTSADREMLKLSSQEKLIGDLPQTPPGAVPDPSLASTDSSEPSPLAGDGAPWSGSSMADTPMSPLLKGSLSQELSKSFLTLTRPDRALVRTSSRREQRRGAGGYQPLDRRGSGEPTPQKAGSSDSCFSGTDRETLSSFKSEKTNSTHLDSPPGGPAPEGSDTDPPSEAELPASPDAGVPSDDTLRSFDTVIGAGTPPGLAEPLLVVRPKDLALLRPSKRQPPLRRHSPPGRAPRRPLLEGGGFFEDEDTSEGSELSPASSLRSQRRYSTDSSSSTSCYSPESSRGAAGGPRKRRAPHGAEEGTAVPPKRPYGTQRTPSTASAKTHARVLSMDGAGGDVLRPPLAGCKAELEAQVGVEQAASEPVVLPAEARRGPAANQPGWRGELQEEGAVGGAAEETGRRDRSSSVRRTQAIRRRHNAGSNPTPPASVMGSPPSSLQEAQRGRAASHSRALTLPSALHFASSLLLTRAGANVHEACTFDDTSEGAVHYFYDESGTDTRIPPASTRLMSLRLQAA

SEQ ID NO: 740880 - protein, 846 aa, Homo sapiens
QGDSNPPRDPGVEMTVFRKVSSTPPVRCSSQHSVFGFNQVSELLPRMEDSGPLRDIKELVREQGSNNVIVTSADREMLKLSSQEKLIGDLPQTPPGAVPDPSLASTDSSEPSPLAGDGAPWSGSSMADTPMSPLLKGSLSQELSKSFLTLTRPDRALVRTSSRREQRRGAGGYQPLDRRGSGEPTPQKAGSSDSCFSGTDRETLSSFKSEKTNSTHLDSPPGGPAPEGSDTDPPSEAELPASPDAGVPSDDTLRSFDTVIGAGTPPGLAEPLLVVRPKDLALLRPSKRQPPLRRHSPPGRAPRRPLLEGGGFFEDEDTSEGSELSPASSLRSQRRYSTDSSSSTSCYSPESSRGAAGGPRKRRAPHGAEEGTAVPPKRPYGTQRTPSTASAKTHARVLSMDGAGGDVLRPPLAGCKAELEAQVGVEQAASEPVVLPAEARRGPAANQPGWRGELQEEGAVGGAAEETGRRDRSSSVRRTQAIRRRHNAGSNPTPPASVMGSPPSSLQEAQRGRAASHSRALTLPSALHFASSLLLTRAGANVHEACTFDDTSEGAVHYFYDESGDRHSHSSSFHSADVPEATGGLNLLQPRPVVLQGMQVRRVPLEIPEEQTLMEEAPPRAQHSYKYWLLPGRWTSVRYERLALLALLDRTRGVLENIFGVGLSSLVAFLGYLLLLKGFFTDIWVFQFCLVIASCQYSLLKSVQPDAASPMHGHNWVIAYSRPVYFCICCLLIWLLDALGSAQPFPPVSLYGLTLFSASFFFCARDVATVFTLCFPFVFLLGLLPQVNTCPRPRSPPEALPCLHICFALTQFGNSNCPAEVHSPDPFPTLVRVAGFSKPLSGISLC

SEQ ID NO: 740881 - protein, 101 aa, Homo sapiens [sequence omitted]

SEQ ID NO: 740882 - protein, 31 aa, Homo sapiens
MWAGPYFGLTCSFHSLLVKAGLGLSMTQEKG

SEQ ID NO: 740883 - protein, 103 aa, Homo sapiens
METVQELIPLAKEMMAQKRKGKMVKLYVLGSVLALFGVVLGLMETVCSPFTAARRLRDQEAAVAELQAALERQALQKQALQEKGKQQDTVLGGRALSNRQHAS

SEQ ID NO: 740884 - protein, 78 aa, Homo sapiens
LRVPLALTALAWAGEPRRRVSEKRYKRPPDAKAVPAAESPTGRAAAAERRRTLRSVGPTDALTAANCSSRCLLLAPCH

SEQ ID NO: 740885 - protein, 103 aa, Homo sapiens; identical to SEQ ID NO: 740883

SEQ ID NO: 740886 - protein, 501 aa, Homo sapiens
MTFYSEVKQIEEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHRGGDRTGTHMSRAKITSELAKVINDGLYYYEQDLWMEEDENKHTAIKVIVSGQHLSTDALF

SEQ ID NO: 740887 - protein, 159 aa, Homo sapiens
AAATSAGARGEPSPALVLGRSVPQAAVPVRPLALHLAHKARGPGGPFGGEPPPPPPPPSPLPPLLRDPPAEDAREEVAAGPAEKRQPPLLPPKGNPWTKKPPQHLSPDTTGPPPPPLETLEAGLWLLCVGHWQGAGRGDLRDLPARGGGSGHQARVTAG

SEQ ID NO: 740888 - protein, 118 aa, Homo sapiens
RGRGRRAVGAPFGAGRGVTPGAARPRRAAAAAATAAGLSGCLSPVGAGRCPGGETGSRVPWPRGHPGWGGWGRGTMSTRAPMPAAHSREDPPAVTAERESLLAAANRPAEQPPPPECE

SEQ ID NO: 740889 - protein, 483 aa, Homo sapiens
AAATSAGARGEPSPALVLGRSVPQAAVPVRPLALHLAHKARGPGGPFGGEPPPPPPPPSPLPPLLRDPPAEDAREEVAAGPAEKRQPPLLPPKGNPWTKKPPQHLSPDTTGPPPPPLETLEAEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740890 - protein, 405 aa, Homo sapiens
LSGRPSSPSPRLRGQLPALAARASPTRVKLLGLGVLRLRGCPAPEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740891 - protein, 371 aa, Homo sapiens
AAATSAGARGEPSPALVLGRSVPQAAVPVRPLALHLAHKARGPGGPFGGEPPPPPPPPSPLPPLLRDPPAEDAREEVAAGPAEKRQPPLLPPKGNPWTKKPPQHLSPDTTGPPPPPLETLEAEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQI

SEQ ID NO: 740892 - protein, 436 aa, Homo sapiens
AAATSAGARGEPSPALVLGRSVPQAAVPVRPLALHLAHKARGPGGPFGGEPPPPPPPPSPLPPLLRDPPAEDAREEVAAGPAEKRQPPLLPPKGNPWTKKPPQHLSPDTTGPPPPPLETLEAEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRGWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740893 - protein, 1062 aa, Homo sapiens
AAATSAGARGEPSPALVLGRSVPQAAVPVRPLALHLAHKARGPGGPFGGEPPPPPPPPSPLPPLLRDPPAEDAREEVAAGPAEKRQPPLLPPKGNPWTKKPPQHLSPDTTGPPPPPLETLEAEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHRGGDRTGTHMSRAKITSELAKVINDGLYYYEQDLWMEEDENKHTAIKQEVENFKKLNLISKEQFENLTPELPFEPNQEVPVAPSQSRQGGVQGVLHIPKKDLTDELAQKLFDVSEITSAAMVHSLPTAVPESPRIHPTRTPKTPRTPRLQDPNKTPRFYPVVKEPKAIDVKSPRKRKTRHSTNPPLECHVGWVMDSRDHGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 740894 - protein, 395 aa, Homo sapiens
AKLRLGTSAGWRASPTRVKLLGLGVLRLRGCPAPEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740895 - protein, 392 aa, Homo sapiens
WYCRNLGMRASPTRVKLLGLGVLRLRGCPAPEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740896 - protein, 465 aa, Homo sapiens
DPALGPKGKSSARSSQRHVRGPPRPLAAVAAGAGREPAASHRGLVRAPPLSLQSGRPQPVSRESSPSSSLALGGQLGRGRPSGRAAPGRANPSAPAGGPAREGPEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740897 - protein, 416 aa, Homo sapiens
RGRGRRAVGAPFGAGRGVTPGVLPPKGNPWTKKPPQHLSPDTTGPPPPPLETLEAEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740898 - protein, 187 aa, Homo sapiens
MFMFLSLGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740899 - protein, 314 aa, Homo sapiens
MTFYSEVKTNREEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 740900 - protein, 670 aa, Homo sapiens
AAATSAGARGEPSPALVLGRSVPQAAVPVRPLALHLAHKARGPGGPFGGEPPPPPPPPSPLPPLLRDPPAEDAREEVAAGPAEKRQPPLLPPKGNPWTKKPPQHLSPDTTGPPPPPLETLEAEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHRGGDRTGTHMSRAKITSELAKVINDGLYYYEQDLWMEEDENKHTAIKVIVSGQHLSTDALF

SEQ ID NO: 740901 - protein, 666 aa, Homo sapiens
AAATSAGARGEPSPALVLGRSVPQAAVPVRPLALHLAHKARGPGGPFGGEPPPPPPPPSPLPPLLRDPPAEDAREEVAAGPAEKRQPPLLPPKGNPWTKKPPQHLSPDTTGPPPPPLETLEAEFGSLKIIKAGKLKTKKSNKASDFSDMENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHRGGDRTGTHMSRAKITSELAKVINDGLYYYEQDLWMEEDENKHTAIKVTILRTPFLV

SEQ ID NO: 740902 - protein, 109 aa, Homo sapiens
LLSSPWSQGCANDRGLGSWCPQGERRFLQGGPVVPSILTPGDAQGWMESPSRSPGSAATGAFSAVHGTLVPLCQPEGLWVQFPPRWARSPSPAQLRPPDWDGVPSAQCC

SEQ ID NO: 740903 - protein, 199 aa, Homo sapiens
LHSSLGNRVRPCLKKEFECYAKETGVDPIGKNEPLKKVKQGVRHDWIYMLEISLLKQCGGGIKESELWAGRLVRKLLQKSKRRDKDRSELEQPSSGDKKEETKKRVKRWVVKVSWEGRCLLPACYEIPAGTQTGSPPGCMQGTALMQGTGFPSPTGLLQMISRERVDLPDPPFSSQLIPSPRSMGSPSAQLFPVLGSDI

SEQ ID NO: 740904 - protein, 729 aa, Homo sapiens
GFLGIAFHPSFQHNRRLYVYYSVGIRSSEWIRISEFRVSEDDENAVDHSSERIILEVKEPASNHNGGQLLFGDDGYLYIFTGDGGMAGDPFGTFGNAQNKSALLGKVLRIDVDRKERGLPYGIPPDNPFVGDPAAQPEVYALGVRNMWRCSFDRGDPSSGTGRGRLFCGDVGQNKFEEVDVVERGGNYGWRAREGFECYDRSLCANTSLNDLLPIFAYPHTVGKSVTGGYVYRGCEYPNLNGLYIFGDFMSGRLMSLQENPGTGQWQYSEICMGHGQTCEFPGLINNYYPYIISFGEDEAGELYFMSTGEPSATAPRGVVYKIIDASRRAPPGKCQIQPAQVKIRSRLIPFVPKEKFIPKTRSTPRPTARAPTRAPRRGRPTAAPPAPTPRPARPTQQPGSRRGGGRRRGRLNSASRAFRDGEVRLVRPAGLSSGSGRVEVFVGGRWGTVCDDSWNISGAAVVCRQLGFAYAVRAVKRAEFGQGGSLPILLDDVRCAGWERNLLECQHNGVGTHNCEHDEDAGVVCSHQNPDLRQHAAAPGHPAGGGAWQGPLRPVCAQRVHTCSRVKGVRVCAVLEDMCEALQCMCVLCRPKAGVCVGGGVGSGSAWSIMGGRSSFLTSKRFRHQQEQQPGCGTLRREGSQASRTDMAPGCANRGTACRLRAVGRTRLVLPTAGMEGARTAGGWPEECGPDSMAWCPHPPHPLAVRGAGENRKASSGEGKAFWKVGAG

SEQ ID NO: 740905 - protein, 115 aa, Homo sapiens
MAGTVLGVGAGVFILALLWVAVLLLCVLLSRASGAARFSVIFLFFGAVIITSVLLLFPRAGEFPAPEVEVKIVDDFFIGRYVLLAFLSAIFLGGLFLVLIHYVLEPIYAKPLHSY

SEQ ID NO: 740906 - protein, 115 aa, Homo sapiens; identical to SEQ ID NO: 740905

SEQ ID NO: 740907 - protein, 146 aa, Homo sapiens
MLSRECVSHWSTEDTRSCGAQGGGPPLPPRGMAGTVLGVGAGVFILALLWVAVLLLCVLLSRASGAARFSVIFLFFGAVIITSVLLLFPRAGEFPAPEVEVKIVDDFFIGRYVLLAFLSAIFLGGLFLVLIHYVLEPIYAKPLHSY

SEQ ID NO: 740908 - protein, 150 aa, Homo sapiens
MPWCLLPVLSVSHWSTEDTRSCGAQGGGPPLPPRGMAGTVLGVGAGVFILALLWVAVLLLCVLLSRASGAARFSVIFLFFGAVIITSVLLLFPRAGEFPAPEVEVKIVDDFFIGRYVLLAFLSAIFLGGLFLVLIHYVLEPIYAKPLHSY

SEQ ID NO: 740909 - protein, 115 aa, Homo sapiens; identical to SEQ ID NO: 740905

SEQ ID NO: 740910 - protein, 146 aa, Homo sapiens; identical to SEQ ID NO: 740907

SEQ ID NO: 740911 - protein, 115 aa, Homo sapiens; identical to SEQ ID NO: 740905

SEQ ID NO: 740912 - protein, 110 aa, Homo sapiens
MPWCLLPVLSVSHWSTEDTRSCGAQGGGPPLPPRGMAGTVLGVGAGVFILALLWVAVLLLCVLLSRASGAARNWELPRINGNAPSWYLSRKKDFGMKRLLTAGLWTLLRD

SEQ ID NO: 740913 - protein, 270 aa, Homo sapiens
MAQSRDGGNPFAEPSELDNPFQPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNLFDSLHSSARCALSPALAPRGIPADRPGPPGTPLRLVGPPPLGPSSEAPHAALTHGVPPRRRDI

SEQ ID NO: 740914 - protein, 148 aa, Homo sapiens
MAQSRDGGNPFAEPSELDNPFQPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCE

SEQ ID NO: 740915 - protein, 297 aa, Homo sapiens
MAQSRDGGNPFAEPSELDNPFQDPAVIQHRPSRQYATRDVYNPFETREVPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNLFDSLHSSARCALSPALAPRGIPADRPGPPGTPLRLVGPPPLGPSSEAPHAALTHGVPPRRRDI

SEQ ID NO: 740916 - protein, 299 aa, Homo sapiens
MAQSRDGGNPFAEPSELDNPFQPPPAYEPPAPAPLPPPSAPSLQPSRKLSPTEPKNYGSYSTQVQEVLQVRAGEKGQSWGPGLTSPSAHTGQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNLFDSLHSSARCALSPALAPRGIPADRPGPPGTPLRLVGPPPLGPSSEAPHAALTHGVPPRRRDI

SEQ ID NO: 740917 - protein, 593 aa, Homo sapiens
TTSIDVDLEMARDTFKKLTKKEWISSMITTCLEDDLLRALPCHSPHQEALSVFLLLPECPVMHDSKNWKNLVVPFAKAVCEMSKQSLQVLKKCWAFLQESSLNPLIQMLKAAIISQLLHQTKTEQDHCNVKALLGMMKELHKVNKANCRLPENTFNINELSNLLNFYIDRGRQLFRDNHLIPAETPSPVIFSDFPFIFNSLSKIKLLQADSHIKMQMSEKKAYMLMHETILQKKDEFPPSPRFILRVRRSRLVKDALRQLSQAEATDFCKVLVVEFINEICPESGGVSSEFFHCMFEEMTKPEYGMFMYPEMGSCMWFPAKPKPEKKRYFLFGMLCGLSLFNLNVANLPFPLALYKKLLDQKPSLEDLKELSPRLGKSLQEVLDDAADDIGDALCIRFSIHWDQNDVDLIPNGISIPVDQTNKRDYVSKYIDYIFNVSVKAVYEEFQRGFYRVCEKEILRHFYPEELMTAIIGNTDYDWKQFEQNSKYEQGYQKSHPTIQLFWKAFHKLTLDEKKKFLFFLTGRDRLHARGIQKMEIVFRCPETFSERDHPTSITCHNILSLPKYSTMERMEEALQVAINNNRGFVSPMLTQS

SEQ ID NO: 740918 - protein, 593 aa, Homo sapiens; identical to SEQ ID NO: 740917

SEQ ID NO: 740919 - protein, 74 aa, Homo sapiens
RWRVMAAWRCGGGCEHLEDGSHYVAQAGLELLGSSNSPTSAYQAAGTTGLHHCTPPIQVHIPRNEDNAWHKVGI

SEQ ID NO: 740920 - protein, 118 aa, Homo sapiens
MIEERDTYCKYGVDEIYRLDVYSRDSRDVVDTYIVSVSDVIKLMIQRQDTSIYDFTDALDIHTTRLVEWYQREKIRVSNIYVYKKMLHEDEEEPANNYESRLRIMKPDKSELDLVNSN

SEQ ID NO: 740921 - protein, 777 aa, Homo sapiens
MSAQTSPAEKGLNPGLMCQESYACSGTDEAIFECDECCSLQCLRCEEELHRQERLRNHERIRLKPGHVPYCDLCKGLSGHLPGVRQRAIVRCQTCKINLCLECQKRTHSGGNKRRHPVTVYNVSNLQESLEAEEMDEETKRKKMTEKVVSFLLVDENEEIQVTNEEDFIRKLDCKPDQHLKVVSIFGNTGDGKSHTLNHTFFYGREVFKTSPTQESCTVGVWAAYDPVHKVAVIDTEGLLGATVNLSQRTRLLLKVLAISDLVIYRTHADRLHNDLFKFLGDASEAYLKHFTKELKATTARCGLDVPLSTLGPAVIIFHETVHTQLLGSDHPSEVPEKLIQDRFRKLGRFPEAFSSIHYKGTRTYNPPTDFSGLRRALEQLLENNTTRSPRHPGVIFKALKALSDRFSGEIPDDQMAHSSFFPDEYFTCSSLCLSCGVGCKKSMNHGKEGVPHEAKSRCRYSHQYDNRVYTCKACYERGEEVSVVPKTSASTDSPWMGLAKYAWSGYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 740922 - protein, 362 aa, Homo sapiens
MAHSSFFPDEYFTCSSLCLSCGVGCKKSMNHGKEGVPHEAKSRCRYSHQYDNRVYTCKACYERGEEVSVVPKTSASTDSPWMGLAKYAWSGYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 740923 - protein, 214 aa, Homo sapiens
MNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 740924 - protein, 777 aa, Homo sapiens; identical to SEQ ID NO: 740921

SEQ ID NO: 740925 - protein, 744 aa, Homo sapiens
MSAQTSPAEKGLNPGLMCQESYACSGTDEAIFECDECCSLQCLRCEEELHRQERLRNHERIRLKPGHVPYCDLCKGLSGHLPGVRQRAIVRCQTCKINLCLECQKRTHSGGNKRRHPVTVYNVSNLQESLEAEEMDEETKRKKMTEKVVSFLLVDENEEIQVTNEEDFIRKLDCKPDQHLKVVSIFGNTGDGKSHTLNHTFFYGREVFKTSPTQESCTVGVWAAYDPVHKVAVIDTEGLLGATVNLSQRTRLLLKVLAISDLVIYRTHADRLHNDLFKFLGDASEAYLKHFTKELKATTARCGLDVPLSTLGPAVIIFHETVHTQLLGSDHPSEVPEKLIQDRFRKLGRFPEAFSSIHYKGTRTYNPPTDFSGLRRALEQLLENNTTRSPRHPGVIFKALKALSDRFSGEIPDDQMAHSSFFPDEYFTCSSLCLSCGVGCKKSMNHGKEGVPHEAKSRCRYSHQYDNRVYTCKYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 740926 - protein, 422 aa, Homo sapiens
MLQWRRRHCCFAKMTWNAKRSLFRTHLIGVLSLVFLFAMFLFFNHHDWLPGRAGFKENPVTYTFRGFRSTKSETNHSSLRNIWKETVPQTLRPQTATNSNNTDLSPQGVTGLENTLSANGSIYNEKGTGHPNSYHFKYIINEPEKCQEKSPFLILLIAAEPGQIEARRAIRQTWGNESLAPGIQITRIFLLGLSIKLNGYLQRAILEESRQYHDIIQQEYLDTYYNLTIKTLMGMNWVATYCPHIPYVMKTDSDMFVNTEYLINKLLKPDLPPRHNYFTGYLMRGYAPNRNKDSKWYMPPDLYPSERYPVFCSGTGYVFSGDLAEKIFKVSLGIRRLHLEDVYVGICLAKLRIDPVPPPNEFVFNHWRVSYSSCKYSHLITSHQFQPSELIKYWNHLQQNKHNACANAAKEKAGRYRHRKLH

SEQ ID NO: 740927 - protein, 422 aa, Homo sapiens; identical to SEQ ID NO: 740926

SEQ ID NO: 740928 - protein, 422 aa, Homo sapiens; identical to SEQ ID NO: 740926

SEQ ID NO: 740929 - protein, 96 aa, Homo sapiens
DELLALLCARMAHSGCRRPAGTVHAVISSSRAPGYLCPELRGVSHAMAPSDELARASQTGGKRAWQLHHVYVSPSWVSLVSVSQSVKWASFGCSMD

SEQ ID NO: 740930 - protein, 147 aa, Homo sapiens
VLEPHEKYPLINKQSAVITKSNPACSIPNYVSLPGPMFHHAGKKPGTLGLAFSRKPQLLVIENKVCNRYEYLNGRIKSTELCARHLAGGTDSCKGDSGGPLVCFEKDKYILQGVTSWGLGCARPNKPGVYVRVSRFVTWIEGVMRNN

SEQ ID NO: 740931 - protein, 1080 aa, Homo sapiens
ASAMTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEVMLSPAMQGVILAIAKARQTFDRDGSEAGLIKAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 740932 - protein, 753 aa, Homo sapiens
MSFLKSLSLCLGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 740933 - protein, 586 aa, Homo sapiens
ASAMTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVE

SEQ ID NO: 740934 - protein, 1080 aa, Homo sapiens; identical to SEQ ID NO: 740931

SEQ ID NO: 740935 - protein, 575 aa, Homo sapiens
AGCTKGYRRTHALRSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 740936 - protein, 118 aa, Homo sapiens
CLPFSHPPSFIFPVASSLRLPLTPACVSISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 740937 - protein, 446 aa, Homo sapiens
MSELGTRKPSDGTVSHLLNVVESELQAGREKGDPTEKQLQIILEDAPLWQRFKEVTNEMIVTKNGRRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLGGWIFSNPDGVCTAGNSNYQYAAPLPLPAPHTHHGCEHYSGLRGHRQAPYPSAYMHRNHSPSVNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 740938 - protein, 107 aa, Homo sapiens
MPVILLLTYFRHHFCPFPLPERNSVLVFLLPLLIFYNSIYGVLNCGPPKICPSLNPGAYKCDLIWEKSLTDEIKLKILPWINQVDAKSNKKVSVQEEKRRITEKKAM

SEQ ID NO: 740939 - protein, 162 aa, Homo sapiens
SPSGKAGESQRAGPSPVARCGRGDDGASGSDGNPASPDRSRQDGAEPAGQGGTTASAGRAQRPTPHRDAENHPVPANTHVGAMAGDRSPLLTRPASHPAHPTTRTHSFVPARVSLSTPSLPPEFSCSRGRRGLATNKGHNPTSTRAARGTRSAKEEGHVGAS

SEQ ID NO: 740940 - protein, 973 aa, Homo sapiens
SGPFCIMVVDFCRRFVARSLCIILMKHFCSSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRVKFNQKICTRFHLETSWAEASNDLLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 740941 - protein, 936 aa, Homo sapiens
RAGHHLQCPLPSVAGRISCILTVLNLSFPVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 740942 - protein, 844 aa, Homo sapiens
MNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 740943 - protein, 936 aa, Homo sapiens; identical to SEQ ID NO: 740941

SEQ ID NO: 740944 - protein, 114 aa, Homo sapiens
MEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 740945 - protein, 114 aa, Homo sapiens; identical to SEQ ID NO: 740944

SEQ ID NO: 740946 - protein, 438 aa, Homo sapiens
RAGHHLQCPLPSVAGRISCILTVLNLSFPVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDG

SEQ ID NO: 740947 - protein, 675 aa, Homo sapiens
RAGHHLQCPLPSVAGRISCILTVLNLSFPVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNSSQQQAPAFHGNTVSSCSFPVYTTAFLLNGVQ

SEQ ID NO: 740948 - protein, 196 aa, Homo sapiens
MRPEKCRRFVHPQWQLLHLNGTFPNTSDADMEPCVDGWVYDRISFSSTIVTEWDLVCDSQSLTSVAKFVFMAGMMVGGILGGHLSDRFGRRFVLRWCYLQVAIVGTCAALAPTFLIYCSLRFLSGIAAMSLITNTIMLIAEWATHRFQAMGITLGMCPSGIAFMTLAGLAFAIRDWHILQLVVSVPYFVIFLTSRF

SEQ ID NO: 740949 - protein, 339 aa, Homo sapiens
MRPEKCRRFVHPQWQLLHLNGTFPNTSDADMEPCVDGWVYDRISFSSTIVTEWDLVCDSQSLTSVAKFVFMAGMMVGGILGGHLSDRFGRRFVLRWCYLQVAIVGTCAALAPTFLIYCSLRFLSGIAAMSLITNTIMLIAEWATHRFQAMGITLGMCPSGIAFMTLAGLAFAIRDWHILQLVVSVPYFVIFLTSSWLLESARWLIINNKPEEGLKELRKAAHRSGMKNARDTLTLEILKSTMKKELEAAQKKKPSLCEMLHMPNICKRISLLSFTRFANFMAYFGLNLHVQHLGNNVFLLQTLFGAVILLANCVAPWALGVRESLQQGEGELFGTICSS

SEQ ID NO: 740950 - protein, 246 aa, Homo sapiens
MRPEKCRRFVHPQWQLLHLNGTFPNTSDADMEPCVDGWVYDRISFSSTIVTEWDLVCDSQSLTSVAKFVFMAGMMVGGILGGHLSDSSRVGNTQIPGHGNYIGNVPFWYCIYDPGRPGFCHSRLAYPPAGGVCTILCDLSDLKILKSTMKKELEAAQKKKPSLCEMLHMPNICKRISLLSFTRFANFMAYFGLNLHVQHLGNNVFLLQTLFGAVILLANCVAPWALGVRESLQQGEGELFGTICSS

SEQ ID NO: 740951 - protein, 108 aa, Homo sapiens
LGGLERERLANCAEFPVVCAVRGACVQPGLGLFDLGTGSDRHNNNNRVWHFLPSINNVPKMADIITSLNLCCFPLSFLGLNSTWTKSSNCKRLNFKSVSLPPFSTALR

SEQ ID NO: 740952 - protein, 343 aa, Homo sapiens
PGTASLVRAAGQGAMAALGGDGLRLLSVSRPERPPESAALGGLGPGLCCWVSVFSCLSLACSYVGSLYVWKSELPRDHPAVIKRRFTSVLVVSSLSPLCVLLWRELTGIQPGTSLLTLMGFRLEGIFPAALLPLLLTMILFLGPLMQLSMDCPCDLADGLKVVLAPRSWARCLTDMRWLRNQVIAPLTEELVFRACMLPMLAPCMGLGPAVFTCPLFFGVAHFHHIIEQLRFRQSSVGNIFLSAAFQFSYTAVFGAYTAFLFIRTGHLIGPVLCHSFCNYMGFPAVCAALEHPQRRPLLAGYALGVGLFLLLLQPLTDPKLYGSLPLCVLLERAGDSEAPLCS

SEQ ID NO: 740953 - protein, 185 aa, Homo sapiens
PGTASLVRAAGQGAMAALGGDGLRLLSVSRPERPPESAALGGLGPGLCCWVSVFSCLSLACSYVGSLYVWKSELPRDHPAVIKRRFTSVLVVSSLSPLCVLLWRELTGIQPGTSLLTLMGFRLEGIFPAALLPLLLTMILFLGPLMQLSMDCPCDLADGLKVVLGHLKTLGLCWVHTPVLSSIDA

SEQ ID NO: 740954 - protein, 343 aa, Homo sapiens; identical to SEQ ID NO: 740952

SEQ ID NO: 740955 - protein, 168 aa, Homo sapiens [sequence omitted]

SEQ ID NO: 740956 - protein, 43 aa, Homo sapiens
MSLMATLEKELGTEGHSIGEATDRGKLGCRTAVGGGAGSYCPR

SEQ ID NO: 740957 - protein, 155 aa, Homo sapiens
MAVPGCNKDSVRAGCKKCGYPGHLTFECRNFLRVDPKRDIVLDVSSTSSEDSDEENEELNKLQALQEKRINEEEEKKKEKSKEKIKLKKKRKRSYSSSSTEEDTSKQKKQKYQKKEKKKEKKSKSKKGKHHKKEKKKRKKEKHSSTPNSSEFSRK

SEQ ID NO: 740958 - protein, 106 aa, Homo sapiens
MAVPGCNKDSVRAGCKKCGYPGHLTFECRNFLRVDPKRDIVLDVSSTSSEDSDEENEELNKLQALQEKRINEEEEKKKEKSKEKIKLKKKRKRYFLNNILKNKAGL

SEQ ID NO: 740959 - protein, 71 aa, Homo sapiens
LVLPSLEAYRPFPTVARVLLRWGKENAALTVPCSHSWREASAFSKARGSSYPSYHRHGSPRLQQGQCQSRL

SEQ ID NO: 740960 - protein, 77 aa, Homo sapiens
TGSAVARGVQALPDRSEGAAALGEGKRRFDCALFSQLAGSKRLFESQRLELPLLPPSWQSQLLKLPPTFMSVIHHSP

SEQ ID NO: 740961 - protein, 80 aa, Homo sapiens
TGSAVARGVQALPDRSEGAAALGEGKRRFDCALFSQLAGSKRLFESQRLELPLLPPSWQSQVRSNYRASALQQGQCQSRL

SEQ ID NO: 740962 - protein, 121 aa, Homo sapiens
SKNSKFIVLRECKYMKHFLSLCLYSLPYSKKNLRQFKSHLNLSISHKCNSQSVCIIIHRSYSSSSTEEDTSKQKKQKYQKKEKKKEKKSKSKKGKHHKKEKKKRKKEKHSSTPNSSEFSRK

SEQ ID NO: 740963 - protein, 158 aa, Homo sapiens
QRIPLFPSLCYPGHLTFECRNFLRVDPKRDIVLDVSSTSSEDSDEENEELNKLQALQEKRINEEEEKKKEKSKEKIKLKKKRKRSYSSSSTEEDTSKQKKQKYQKKEKKKEKKENKLIFLLYGNTVFLQWSHECFLLLHGLEAAMAKLGGGVNELKVN

SEQ ID NO: 740964 - protein, 77 aa, Homo sapiens; identical to SEQ ID NO: 740960

SEQ ID NO: 740965 - protein, 135 aa, Homo sapiens
MAVPGCNKDSVRAGCKKCGYPGHLTFECRNFLRVDPKRDIVLDVSSTSSEDSDEENEELNKLQALQEKRINEEEEKKKEKSKEKIKLKKKRKRAYSFKFHLKQRHLLKTQSKQKLFIRTASYHNDKNGVKSKTKR

SEQ ID NO: 740966 - protein, 234 aa, Homo sapiens
GSRRRQRGCISVQPARPLLEEDWTKGVTHSFHTVEPLPAWCWSQFSFFMMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPSAAQYPFHSYWLHKMS

SEQ ID NO: 740967 - protein, 120 aa, Homo sapiens
GSRRRQRGCISVQPARPLLEEDWTKGVTHSFHTVEPLPAWCWSQFSFFMMVDPNGNESSATYFILIGLPGLEEAQFWLAFPLCSLYLIAVLASGVTLRCPSSWPISICWFLLCSTQLSME

SEQ ID NO: 740968 - protein, 98 aa, Homo sapiens
DPVACVEGGREGTEGARVKAPPPALAPPSRFSRSRLCASASFSKSALPGPACPGVNFSSQRREEWKPYWMRTGEPVTESRYNADPVKSELYISTYAGQ

SEQ ID NO: 740969 - protein, 102 aa, Homo sapiens
DPVACVEGGREGTEGARVKAPPPALAPPSRFSRSRLCASASFSKSALPGPACPGVNFSSQRREEWKPYWMRTGEPVTESRYNADPVKSERRRPLLVASLLAP

SEQ ID NO: 740970 - protein, 143 aa, Homo sapiens
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGK

SEQ ID NO: 740971 - protein, 122 aa, Homo sapiens
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSECETKGESQNTDLSPKPLISEQTVILGK

SEQ ID NO: 740972 - protein, 91 aa, Homo sapiens
AQTGRGSPLSEGAAGCRSFAREAAALTVSGGRVSSPARTLSHHGHRSRCVLHTNRGLFPASTHCLLRLRWSPPLTDARRPPPQGQGRALSP

SEQ ID NO: 740973 - protein, 120 aa, Homo sapiens
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWGWSAV

SEQ ID NO: 740974 - protein, 142 aa, Homo sapiens
GPSGRRRRSLFSDAPCREHAGPDTAKSGCASDLAALSLLSGRNNLTQVIKQEDFSVATKEEKGPLRRRHSHCSGAGTSQAAEGKVVPSSGNRKGKRLGGGNELEFQDGRSQRKSRRDCGAGRGVLHRATAAGAREPGLRAAP

SEQ ID NO: 740975 - protein, 123 aa, Homo sapiens
MQAKEGSFTLSRPHSCYTNGFCCGYPMSGVRRQWYDSSLCVRNWWVLGLTDVKNEAADPRGTASSNGFHLAFPTIIAFTSQGANVGVLPAAKYVYANYASWHLENDHRMSLGTHWTRCKLDLS

SEQ ID NO: 740976 - protein, 77 aa, Homo sapiens
MHPLPITDIRIWFYLQQPLSFAKLTFEDVAVLLSQDEWDRLCPAQRGLYRNVMMETYGNVVSLGKPPSAGLVYVSAY

SEQ ID NO: 740977 - protein, 179 aa, Homo sapiens
GPSGRRRRSLFSDAPCREHAGPDTAKSGCASDLAALSLLSGRNNLTQVIKQEDFSVATKEEKGPLRRRHSHCSGAGTSQAAEGKVVPSSGNRKGKRLGGGNELEFQDGRSQRKSRRDCGAGRGVLHRATAAGAREPGLRAGKARRWAVTSAPGSAAGEPAGPIAQRCSAPLGIAEVWLS

SEQ ID NO: 740978 - protein, 120 aa, Homo sapiens; identical to SEQ ID NO: 740973

SEQ ID NO: 740979 - protein, 251 aa, Homo sapiens
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWDPVPQKPGDVSIPMQAKEGSFTLSRPHSCYTNGFCCGYPMSGVRRQWYDSSLCVRNWWVLGLTDVKNEAADPRGTASSNGFHLAFPTIIAFTSQGANVGVLPAAKYVYANYASWHLENDHRMSLGTHWTRCKLDLS

SEQ ID NO: 740980 - protein, 200 aa, Homo sapiens
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGKECSFEQLEHVREMQEKLARLHFSLDVCGEEEDDEEEEDGVTEGLPEEQKKTMADRNLDQLLSNLEDLSNSIQKLHLAENAEPEEQSAA

SEQ ID NO: 740981 - protein, 200 aa, Homo sapiens; identical to SEQ ID NO: 740980

SEQ ID NO: 740982 - protein, 224 aa, Homo sapiens
MTEPNIRRKRQRTSTTDAHENKTAPTGRKQRAETERAEETPHTRGEEKRRGTRPRREKERKRGEREKKRRERETWKRKEEGTEREISSDAIIKEKSIIEADYGNKSDVVSRVRQETKRKEIKTNQIKMNRVFRKEKQGGGAGEEEKRKEEKKKEVRGEKREDRTSEAREARRTGRGSTARRGQGGGHAGERAGAEGEGGGKGSPGAQARDEKTQEEEQDGRGEK

SEQ ID NO: 740983 - protein, 87 aa, Homo sapiens
CLTAPYPVIMVMSTPPRVGKEKCRPVLAGGGSGSAGTPLQHSFLTEVTDVYEMEGGLLNLLNDFHSGRLQAFGESWGLVSAGVWIGL

SEQ ID NO: 740984 - protein, 200 aa, Homo sapiens; identical to SEQ ID NO: 740980

SEQ ID NO: 740985 - protein, 241 aa, Homo sapiens
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGKECSFEQLEHVREMQEKLARLHFSLDVCGEEEDDEEEEDGVTEGLPEEQKKTMADRNLDQLLSNLEDLSNSMYPFQGTRLCVCVPERSVSSSPALQEYSHTTNFPTSCSPVRFSHRLPKPRYRNLEFPQN

SEQ ID NO: 740986 - protein, 135 aa, Homo sapiens
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFAGRTHNFIQKLHLAENAEPEEQSAA

SEQ ID NO: 740987 - protein, 125 aa, Homo sapiens
LVAQAGVQWHDLSSPQPLSPGFKRFSCLSLLGSWDYRYAPPCPANFVFLVEMGFLHVGQAGLELPTSGDPPALASQSAGITGMSHRPWQQFLVSECLVESRKTPWWVLYTKSTSPIYFVLQSLLV

SEQ ID NO: 740988 - protein, 408 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKVTVAPFNPTVCDALLDKDETDSSKDTEKLSSLGEEMREDGLSPNESKLCTESEGISPNNSAWNGPQLSSSNNNFQQTVSDKNMPDSENPTSVFSRISDHSETPNMELSCRNGGSHKSSCEMRSLVVSTSSNKQDVLNKDSGKMKGHERRLGKVIPVLQTKTRTNVPTFSQSNLEQQKQLYLRSVIAHIEDPEDTNQGISGELCALMDQVHHMQHSKWQHPSDLTTRNYARRQKHLQRYSLTQWVDRNMRSHHRFQRLPDFSYS

SEQ ID NO: 740989 - protein, 408 aa, Homo sapiens; identical to SEQ ID NO: 740988

SEQ ID NO: 740990 - protein, 408 aa, Homo sapiens; identical to SEQ ID NO: 740988

SEQ ID NO: 740991 - protein, 408 aa, Homo sapiens; identical to SEQ ID NO: 740988

SEQ ID NO: 740992 - protein, 272 aa, Homo sapiens
DSAGSGLRGCAGPKRWLLSSRGLKDELLCSICLSIYQDPVSLGCEHYFCRRCITEHWVRQEAQGARDCPECRRTFAEPALAPSLKLANIVERYSSFPLDAILNARRAARPCQAHDKVKLFCLTDRALLCFFCDEPALHEQHQVTGIDDAFDELQRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSER

SEQ ID NO: 740993 - protein, 475 aa, Homo sapiens
MACSLKDELLCSICLSIYQDPVSLGCEHYFCRRCITEHWVRQEAQGARDCPECRRTFAEPALAPSLKLANIVERYSSFPLDAILNARRAARPCQAHDKVKLFCLTDRALLCFFCDEPALHEQHQVTGIDDAFDELQRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVPAALTLDPGTAHQRLILSDDCTIVAYGNLHPQPLQDSPKRFDVEVSVLGSEAFSSGVHYWEVVVAEKTQWVIGLAHEAASRKGSIQIQPSRGFYCIVMHDGNQYSACTEPWTRLNVRDKLDKVGVFLDYDQGLLIFYNADDMSWLYTFREKFPGKLCSYFSPGQSHANGKNVQPLRINTVRI

SEQ ID NO: 740994 - protein, 475 aa, Homo sapiens; identical to SEQ ID NO: 740993

SEQ ID NO: 740995 - protein, 475 aa, Homo sapiens; identical to SEQ ID NO: 740993

SEQ ID NO: 740996 - protein, 475 aa, Homo sapiens; identical to SEQ ID NO: 740993

SEQ ID NO: 740997 - protein, 631 aa, Homo sapiens
AGRQISPPASLCSGSTSSAMAAPEGSGLGEDARLDQETAQWLRWDKNSLTLEAVKRLIAEGNKEELRKCFGARMEFGTAGLRAAMGPGISRMNDLTIIQTTQGFCRYLEKQFSDLKQKGIVISFDARAHPSSGGSSRRFARLAATTFISQGIPVYLFSDITPTPFVPFTVSHLKLCAGIMITASHNPKQDNGYKVYWDNGAQIISPHDKGISQAIEENLEPWPQAWDDSLIDSSPLLHNPSASINNDYFEDLKKYCFHRSVNRETKVKFVHTSVHGVGHSFVQSAFKAFDLVPPEAVPEQKDPDPEFPTVKYPNPEEGKGVLTLSFALADKTKARIVLANDPDADRLAVAEKQDSGEWRVFSGNELGALLGWWLFTSWKEKNQDRSALKDTYMLSSTVSSKILRAIALKEGFHFEETLTGFKWMGNRAKQLIDQGKTVLFAFEEAIGYMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 740998 - protein, 631 aa, Homo sapiens; identical to SEQ ID NO: 740997

SEQ ID NO: 740999 - protein, 623 aa, Homo sapiens
VATSARGTSSAMAAPEGSGLGEDARLDQETAQWLRWDKNSLTLEAVKRLIAEGNKEELRKCFGARMEFGTAGLRAAMGPGISRMNDLTIIQTTQGFCRYLEKQFSDLKQKGIVISFDARAHPSSGGSSRRFARLAATTFISQGIPVYLFSDITPTPFVPFTVSHLKLCAGIMITASHNPKQDNGYKVYWDNGAQIISPHDKGISQAIEENLEPWPQAWDDSLIDSSPLLHNPSASINNDYFEDLKKYCFHRSVNRETKVKFVHTSVHGVGHSFVQSAFKAFDLVPPEAVPEQKDPDPEFPTVKYPNPEEGKGVLTLSFALADKTKARIVLANDPDADRLAVAEKQDSGEWRVFSGNELGALLGWWLFTSWKEKNQDRSALKDTYMLSSTVSSKILRAIALKEGFHFEETLTGFKWMGNRAKQLIDQGKTVLFAFEEAIGYMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 741000 - protein, 631 aa, Homo sapiens; identical to SEQ ID NO: 740997

SEQ ID NO: 741001 - protein, 274 aa, Homo sapiens
AGRQISPPASLCSGSTSSAMAAPEGSGLGEDARLDQETAQWLRWDKNSLTLEAVKRLIAEGNKEELRKCFGARMEFGTAGLRAAMGPGISRMNDLTIIQTTQGFCRYLEKQFSDLKQKGIVISFDARAHPSSGGSSRRFARLAATTFISQGIPVYLFSDITPTPFVPFTVSHLKLCAGIMITASHNPKQDNGYKVYWDNGAQIISPHDKGISQAIEENLEPWPQAWDDSLIDSSPLLHNPSASINNDYFEDLKKYCFHRLCLLLWLTKPRPELF

SEQ ID NO: 741002 - protein, 518 aa, Homo sapiens
NSLTNPFIVRRNDLSSSIQWGSSRRFARLAATTFISQGIPVYLFSDITPTPFVPFTVSHLKLCAGIMITASHNPKQDNGYKVYWDNGAQIISPHDKGISQAIEENLEPWPQAWDDSLIDSSPLLHNPSASINNDYFEDLKKYCFHRSVNRETKVKFVHTSVHGVGHSFVQSAFKAFDLVPPEAVPEQKDPDPEFPTVKYPNPEEGKGVLTLSFALADKTKARIVLANDPDADRLAVAEKQDSGEWRVFSGNELGALLGWWLFTSWKEKNQDRSALKDTYMLSSTVSSKILRAIALKEGFHFEETLTGFKWMGNRAKQLIDQGKTVLFAFEEAIGYMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 741003 - protein, 103 aa, Homo sapiens
VATSARGTSSAMAAPEGSGLGEDARLDQETAQWLRWDKNSLTLEAVKRLIAEGNKEELRKCFGARMEFGTAGLRAAMGPGISRMNDLTIIQTTQLCAVSFQGF

SEQ ID NO: 741004 - protein, 2555 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCPCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCMCMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDPDNAYLCFCLKGTTGPNCEINLDDCASSPCDSGTCLDKIDGYECACEPGYTGSMCNSNIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLLGGTCQDGRGLHRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 741005 - protein, 1830 aa, Homo sapiens
SLDLQCGPPCRYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLLGGTCQDGRGLHRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 741006 - protein, 1849 aa, Homo sapiens
VWVISELLFYVFQHTSTGYSDWDDYAYSDVDLRDHHSETTLVAVSLTVGTLKPNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLLGGTCQDGRGLHRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 741007 - protein, 2651 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCPCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCMCMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDPDNAYLCFCLKGTTGPNCEINLDDCASSPCDSGTCLDKIDGYECACEPGYTGSMCNSNIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLLGGTCQDGRGLHRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQTQCECSDLKLTNPPSFKGEKSKSRLQIESAGAGENLAIVCNSDYRVENDLILEERDGGEWVRRRPDAEPVRRPPATSLLRSRCLMSGHLPLAPVPAGETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 741008 - protein, 845 aa, Homo sapiens [sequence omitted]

SEQ ID NO: 741009 - protein, 2049 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCPCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCMCMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDPDNAYLCFCLKGTTGPNCEINLDDCASSPCDSGTCLDKIDGYECACEPGYTGSMCNSNIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLLGGTCQDGRGLHRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSACTGRRREQCDAQTRKDPL

SEQ ID NO: 741010 - protein, 1912 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCPCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCMCMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDPDNAYLCFCLKGTTGPNCEINLDDCASSPCDSGTCLDKIDGYECACEPGYTGSMCNSNIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLLGGTCQDGRGLHRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPGKGASSQGFPSPVAHLPLSPKPRGWGTVDTLET

SEQ ID NO: 741011 - protein, 945 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCPCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCMCMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDPDNAYLCFCLKGTTGPNCEINLDDCASSPCDSGTCLDKIDGYECACEPGYTGSMCNSNIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCDTF

SEQ ID NO: 741012 - protein, 334 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGSAARWPGCTSPSPAARPRGWERGAWCRGSPGRAHGGELGRRDGEFPRLRVVSGGRVWSGVCAGRRLAQGPGASPCLWSFPELTFEL

SEQ ID NO: 741013 - protein, 751 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCPCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCMCMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDPDNAYLCFCLKGTTGPNCEINLDDCASSPCDSGTCLDKIDGYECACEPGYTGSMCNSNIDECAGNPCHNGGTCEDGINGFTCRCPEGYHDPTCLSEVNECNSNPCVHGACRDSLNGVSLYLPASARVLGNR

SEQ ID NO: 741014 - protein, 130 aa, Homo sapiens
MWPQARLPPHPAMAEETRQSKLAAAKRKLKEYWQRNSPGVPAGAKRNRKTNGSIHETATSGGCHSPGDSATGIHGESPTSSATLKDLESPCQELAVVPDSRSVKVSQLKNTIKSLKQQNKQVEHQLEEVT

SEQ ID NO: 741015 - protein, 115 aa, Homo sapiens
AGITSVHHLTQPYLTFSILFSSSLALSPPTPSAHELLLRLEDVIPMLLPLEMSQNFQWINPGRDNYFLFCGLVFHSDLHHSTYMAKTDCFTYGCFIKPEGRRNILGCKACFFASS

SEQ ID NO: 741016 - protein, 727 aa, Homo sapiens
RTACPCVLQPSAGPAEQQQRTLLTARQPPPPAVALLSRWSVRPAHVTMGKSRTKRFKRPQFSPTGDCQAEAAAAANGTGGEEDDGPAAELLEKLQHPSAEVRECACAGLARLVQQRPALPGLARRDAVRRLGPLLLDPSLAVRETAAGALRNPSACGGFEVCDDMVTKDIMTPLVALLKECSAGLDSNEMSLQEKKDQNRNSIENIANETVNVLWNICECSSRAVSIFNKEGCLEIVLKYLSRFPTNVDLAISVAYCLQTVTEDNPELLKSFSATALNMLESALLSPVSSMESLLLKTLVAGTIWNLKDIIPCKSQAEIINALLKILSEVLGMDAGEMVIQMKEAETQRLKTAAEAEEILENTNGDDLIEDDEMEGISHKRRVRRKTFVSDLLPPTDKELRETIALLTAQQTALEIIVNMCCNEDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 741017 - protein, 346 aa, Homo sapiens
MWIEPLFPSYEQTPTDKELRETIALLTAQQTALEIIVNMCCNEDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 741018 - protein, 389 aa, Homo sapiens
RTACPCVLQPSAGPAEQQQRTLLTARQPPPPAVALLSRWSVRPAHVTMGKSRTKRFKRPQFSPTGDCQAEAAAAANGTGGEEDDGPAAELLEKKSSACGGFEVCDDMVTKDIMTPLVALLKECSAGLDSNEMSLQEKKDQNRNSIENIANETVNVLWNICECSSRAVSIFNKEGCLEIVLKYLSRFPTNVDLAISVAYCLQTVTEDNPELLKSFSATALNMLESALLSPVSSMESLLLKTLVAGTIWNLKDIIPCKSQAEIINALLKILSEVLGMDAGEMVIQMKEAETQRLKTAAEAEEILENTNGDDLIEDDEMEGISHKRRVRRKTFVSDLLPPTDKELRETIALLTAQQTALEIIVNMCCNEGLLTFTFRHFPPEPRGKLPWRFS

SEQ ID NO: 741019 - protein, 346 aa, Homo sapiens; identical to SEQ ID NO: 741017

SEQ ID NO: 741020 - protein, 346 aa, Homo sapiens; identical to SEQ ID NO: 741017

SEQ ID NO: 741021 - protein, 669 aa, Homo sapiens
RTACPCVLQPSAGPAEQQQRTLLTARQPPPPAVALLSRWSVRPAHVTMGKSRTKRFKRPQFSPTGDCQAEAAAAANGTGGEEDDGPAAELLEKKSSACGGFEVCDDMVTKDIMTPLVALLKECSAGLDSNEMSLQEKKDQNRNSIENIANETVNVLWNICECSSRAVSIFNKEGCLEIVLKYLSRFPTNVDLAISVAYCLQTVTEDNPELLKSFSATALNMLESALLSPVSSMESLLLKTLVAGTIWNLKDIIPCKSQAEIINALLKILSEVLGMDAGEMVIQMKEAETQRLKTAAEAEEILENTNGDDLIEDDEMEGISHKRRVRRKTFVSDLLPPTDKELRETIALLTAQQTALEIIVNMCCNEDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 741022 - protein, 87 aa, Homo sapiens
ALYTIAAWRACAYMYCDHDRFLSALGTILVMTVVRILIKSASGRPERDGIKADMHIESCRQTSVSIEIEVQREIAYRSSTWMLAGIF

SEQ ID NO: 741023 - protein, 317 aa, Homo sapiens
ARGLEIIANMCCILDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 741024 - protein, 346 aa, Homo sapiens; identical to SEQ ID NO: 741017

SEQ ID NO: 741025 - protein, 389 aa, Homo sapiens; identical to SEQ ID NO: 741018

SEQ ID NO: 741026 - protein, 495 aa, Homo sapiens
MDSLAESRWPPGLAVMKTIDDLLRCGICFEYFNIAMIIPQCSHNYCSLCIRKFLSYKTQCPTCCVTVTEPDLKNNRILDELVKSLNFARNHLLQFALESPAKSPASSSSKNLAVKVYTPVASRQSLKQGSRLMDNFLIREMSGSTSELLIKENKSKFSPQKEASPAAKTKETRSVEEIAPDPSEAKRPEPPSTSTLKQVTKVDCPVCGVNIPESHINKHLDSCLSREEKKESLRSSVHKRKPLPKTVYNLLSDRDLKKKLKEHGLSIQGNKQQLIKRHQEFVHMYNAQCDALHPKSAAEIVQEIENIEKTRMRLEASKLNESVMVFTKDQTEKEIDEIHSKYRKKHKSEFQLLVDQARKGYKKIAGMSQKTVTITKEDESTEKLSSVCMGQEDNMTSVTNHFSQSKLDSPEELEPDREEDSSSCIDIQEVLSSSESDSCNSSSSDIIRDLLEEEEAWEASHKNDLQDTEISPRQNRRTRAAESAEIEPRNKRNRN

SEQ ID NO: 741027 - protein, 495 aa, Homo sapiens; identical to SEQ ID NO: 741026

SEQ ID NO: 741028 - protein, 495 aa, Homo sapiens; identical to SEQ ID NO: 741026

SEQ ID NO: 741029 - protein, 494 aa, Homo sapiens
MDSLAESRWPPGLAVMKTIDDLLRCGICFEYFNIAMIIPQCSHNYCSLCIRKFLSYKTQCPTCCVTVTEPDLKNNRILDELVKSLNFARNHLLQFALESPAKSPASSSSKNLAVKVYTPVASRQSLKQGSRLMDNFLIREMSGSTSELLIKENKSKFSPQKEASPAAKTKETRSVEEIAPDPSEAKRPEPPSTSTLKQVTKVDCPVCGVNIPESHINKHLDSCLSREEKKESLRSSVHKRKPLPKTVYNLLSDRDLKKKLKEHGLSIQGNKQQLIKRHQEFVHMYNAQCDALHPKSAAEIVQEIENIEKTRMRLEASKLNESVMVFTKDQTEKEIDEIHSKYRKKHKSEFQLLVDQARKGYKKIAGMSQKTVTITKEDESTEKLSSVCMGQEDNMTSVTNHFSQSKLDSPEELEPDREEDSSSCIDIQEVLSSSESDSCNSSSSDIIRDLLEEEEAWEASHKLYFSKRRYIFQGSCVSTNPFFCKRTACFYSKL

SEQ ID NO: 741030 - protein, 462 aa, Homo sapiens [sequence omitted]

SEQ ID NO: 741031 - protein, 481 aa, Homo sapiens
MDSLAESRWPPGLAVMKTIDDLLRCGICFEYFNIAMIIPQCSHNYCSLCIRKFLSYKTQCPTCCVTVTEPDLKNNRILDELVKSLNFARNHLLQFALESPAKSPASSSSKNLAVKVYTPVASRQSLKQGSRLMDNFLIREMSGSTSELLIKENKSKFSPQKEASPAAKTKETRSVEEIAPDPSEAKRPEPPSTSTLKQVTKVDCPVCGVNIPESHINKHLDSCLSREEKKESLRSSVHKRKPLPKTVYNLLSDRDLKKKLKEHGLSIQGNKQQLIKRHQEFVHMYNAQCDALHPKSAAEIVQEIENIEKTRMRLEASKLNESVMVFTKDQTEKEIDEIHSKYRKKHKSEFQLLVDQARKGYKKIAGMSQKTVTITKEDESTEKLSSVCMGQEDNMTSVTNHFSQSKLDSPEELEPDREEDSSSCIDIQEVLSSSESDSCNSSSSDIIRDLLEEEEAWEASHKNDLQDTEISPRQNRRTRGS

SEQ ID NO: 741032 - protein, 368 aa, Homo sapiens [sequence omitted]

SEQ ID NO: 741033 - protein, 193 aa, Homo sapiens
MSAQSVEEDSILIIPTPDEEEKILRVKLEEDPDGEEGSSIPWNHLPDPEIFRQRFRQFGYQDSPGPREAVSQLRELCRLWLRPETHTKEQILELVVLEQFVAILPKELQTWVRDHHPENGEEAVTVLEDLESELDDPGQPVSLRRRKREVLVEDMVSQEEAQGLPSSELDAVENQLKWASWELHSLRHCVIIP

SEQ ID NO: 741034 - protein, 128 aa, Homo sapiens
RPPTTTKFAAASTEDSILIIPTPDEEEKILRVKLEEDPDGEEGSSIPWNHLPDPEIFRQRFRQFGYQDSPGPREAVSQLRELCRLWLRPETHTKEQILELVVLEQFVAILPKELQTVDAAANLVVVVD

SEQ ID NO: 741035 - protein, 368 aa, Homo sapiens [sequence omitted]

SEQ ID NO: 741036 - protein, 368 aa, Homo sapiens [sequence omitted]

SEQ ID NO: 741037 - protein, 368 aa, Homo sapiens [sequence omitted]

SEQ ID NO: 741038 - protein, 368 aa, Homo sapiens [sequence omitted]

SEQ ID NO: 741039 - protein, 368 aa, Homo sapiens [sequence omitted]

SEQ ID NO: 741040 - protein, 368 aa, Homo sapiens [sequence omitted]

SEQ ID NO: 741041 - protein, 101 aa, Homo sapiens
NFRPRPTGEKPYGCVECGKAFSRSSILVQHQRVHTGEKPYKCLECGKAFSQNSGLINHQRIHTGEKPYECVQCGKSYSQSSNLFRHQRRHNAEKLLNVVKV

SEQ ID NO: 741042 - protein, 368 aa, Homo sapiens [sequence omitted]

SEQ ID NO: 741043 - protein, 200 aa, Homo sapiens
MSAQSVEEDSILIIPTPDEEEKILRVKLEEDPDGEEGSSIPWNHLPDPEIFRQRFRQFGYQDSPGPREAVSQLRELCRLWLRPETHTKEQILELVVLEQFVAILPKELQTWVRDHHPENGEEAVTVLEDLESELDDPGQPVSLRRRKREVLVEDMVSQEEAQGLPSSELDAVENQLKWASWELHSLRHCGEDQNSVWARG

SEQ ID NO: 741044 - protein, 390 aa, Homo sapiens
SVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPYTCSECGKAFSDRSVLIQHHNVHTGEKPYECSECGKTFSHRSTLMNHERIHTEEKPYACYECGKAFVQHSHLIQHQRVHTGEKPYVCGECGHAFSARRSLIQHERIHTGEKPFQCTECGKAFSLKATLIVHLRTHTGEKPYECNSCGKAFSQYSVLIQHQRIHTGEKPYECGECGRAFNQHGHLIQHQKVHRKL

SEQ ID NO: 741045 - protein, 305 aa, Homo sapiens
SVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPYTCSECGKAFSDRSVLIQHHNVHTGEKPYECSECGKTFSHRSTLMNHERIHTEEKPYACYECGKAFVQHSHLIQHQRVHTGEKPYVCGECGHAFSARRSLIQHERIHTV

SEQ ID NO: 741046 - protein, 266 aa, Homo sapiens
SVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPYTCSECGKAFSDRSVLIQHHNVHTGEKPYECSECGKTFSHRSTLMNHERIHTEADPAPESPHWGEALCVW

SEQ ID NO: 741047 - protein, 388 aa, Homo sapiens
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 741048 - protein, 398 aa, Homo sapiens
MDGLGAGGAAMAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 741049 - protein, 404 aa, Homo sapiens
MAGCCAALAAFLFEYDTPRIVLIRSRKVGLMNRAVQLLILAYVIGCYHPHLAEVEMESPRRWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 741050 - protein, 287 aa, Homo sapiens
MTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 741051 - protein, 422 aa, Homo sapiens
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQVGPSWPPAGTGLSSLGCGSPGRGPVWGGPSAEAGTSVAWCPR

SEQ ID NO: 741052 - protein, 283 aa, Homo sapiens
MATVLCDTGPVPQIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 741053 - protein, 163 aa, Homo sapiens
AGTVRKCYDRLGAGGAAMAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNDLLF

SEQ ID NO: 741054 - protein, 258 aa, Homo sapiens
MAGCCAALAAFLFEYDTPRIVLIRSRKVGLMNRAVQLLILAYVIGPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 741055 - protein, 350 aa, Homo sapiens
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQREDLYMCRTYPLNYSEGCPVENVALRMPSPAVDSGGERLPAL

SEQ ID NO: 741056 - protein, 185 aa, Homo sapiens
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQEAAWLQSLDL

SEQ ID NO: 741057 - protein, 371 aa, Homo sapiens
MAAPALRLCHIAFHVPAGQPLARNLQRLFGFQPLASREVDGWRQLALRSGDAVFLVNEGAGSGEPLYGLDPRHAVPSATNLCFDVADAGAATRELAALGCSVPVPPVRVRDAQGAATYAVVSSPAGILSLTLLERAGYRGPFLPGFRPVSSAPGPGWVSRVDHLTLACTPGSSPTLLRWFHDCLGFCHLPLSPGEDPELGLEMTAGFGLGGLRLTALQAQPGSIVPTLVLAESLPGATTRQDQVEQFLARHKGPGLQHVGLYTPNIVEATEGVATAGGQFLAPPGAYYQQPGKERQIRAAGHEPHLLARQGILLDGDKGKFLLQVFTKSLFTEDTFFLELIQRQGATGFGQGNIRALWQSVQEQSARSQEA

SEQ ID NO: 741058 - protein, 371 aa, Homo sapiens; identical to SEQ ID NO: 741057

SEQ ID NO: 741059 - protein, 235 aa, Homo sapiens
MAAPALRLCHIAFHVPAGQPLARNLQRLFGFQPLASREVDGWRQLALRSGDAVFLVNEGAGSGEPLYGLDPRHAVPSATNLCFDVADAGAATRELAALGCSVPVPPVRVRDAQGAATYAVVSSPAGILSLTLLERAGYRGPFLPGFRPVSSAPGPGWVSRVDHLTLADPESQLCAGPAAGFAWRSRGVRVVDEGGWVGKRAGGCPFLLPRAPLCCPGGGSLAGEFSPMGLSFARA

SEQ ID NO: 741060 - protein, 371 aa, Homo sapiens; identical to SEQ ID NO: 741057

SEQ ID NO: 741061 - protein, 150 aa, Homo sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 741062 - protein, 84 aa, Homo sapiens
MNLWLLACLVAGFLGAWAPAVHTQGVFEDCCLAYHYPIGWAVLRRAWTYRIQEVSGSCNLPAAIRPSCCKEVEFWKLQVIIIQV

SEQ ID NO: 741063 - protein, 89 aa, Homo sapiens
FLPGVTGGPWCLYSGSAASPTPFLVPVAPACSSNLQPPKPSVIPRPLCSHWPHKSPILGPGVLSPSILSVTSVLVCSYLHVNLEMAVAL

SEQ ID NO: 741064 - protein, 128 aa, Homo sapiens
SWSWDRRKKEKCIKNTQPGGRTQPFLPEGGREGNKRSRRFGPSIITPTMRTTAPSCVSGAKQRKIHIWGQNPCERQNLEGRGPKDTEPAPGKGGGKGKRCLDASKGFVFPPKFAHPASSPSLQVPIQR

SEQ ID NO: 741065 - protein, 136 aa, Homo sapiens
MARTKQTARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 741066 - protein, 121 aa, Homo sapiens
PCFMENKHSLQVMKTRCREDKFKKLKSKPAHVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 741067 - protein, 105 aa, Homo sapiens
VITNYNQEQLGVFMGFGVFFSKKLVFQPANFQYFPFCHLLTFFFCSSHSIVIALRTVQLSFNTGMVSFCSITELGILILYYSVLLPLSPEAKRMKIGAGRSASHL

SEQ ID NO: 741068 - protein, 626 aa, Homo sapiens
MAARPAATLAWSLLLLSSALLREGCRARFVAERDSEDDGEEPVVFPESPLQSPTVLVAVLARNAAHTLPHFLGCLERLDYPKSRMAIWAATDHNVDNTTEIFREWLKNVQRLYHYVEWRPMDEPESYPDEIGPKHWPTSRFAHVMKLRQAALRTAREKWSDYILFIDVDNFLTNPQTLNLLIAENKTIVAPMLESRGLYSNFWCGITPKGFYKRTPDYVQIREWKRTGCFPVPMVHSTFLIDLRKEASDKLTFYPPHQDYTWTFDDIIVFAFSSRQAGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 741069 - protein, 626 aa, Homo sapiens; identical to SEQ ID NO: 741068

SEQ ID NO: 741070 - protein, 67 aa, Homo sapiens
VHGVRACCGHLNLPGAAGFQPLIGMLGRAEGESLLGRMRHTCVQAHTGSDLASSETVQSGTLLLPAL

SEQ ID NO: 741071 - protein, 73 aa, Homo sapiens
MFDAPPPTKLEHPRSTSDCCAGSKNFKPVDLRFLGSMGVGYAELDHPSPWLQPPFQESEQFCLAAIPGATGAL

SEQ ID NO: 741072 - protein, 110 aa, Homo sapiens
MYYLQPGPLSSMLQTPIAICLFDSSPGVGRGGSHVSLQHLKNLPRPKFVIFLHKSGPPPLFTSQDWALCPSSWACQNLEVVNTSPFSTSESPFKSVPFNSVSTITSPGLQ

SEQ ID NO: 741073 - protein, 235 aa, Homo sapiens
MGSRKKEIALQVNISTQELWEEMLSSKGLTVVDVYQGWCGPCKPVVSLFQKMRIEVGLDLLHFALAEADRLDVLEKYRGKCEPTFLFYAGGELVAVVRGANAPLLQKTILDQLEAEKKVLAEGRERKVIKDEALSDEDECVSHGKNNGEDEDMVSSERTCTLAIIKPDAVAHGKTDEIIMKIQEAGFEILTNEERTMTEAEVRLFYQHKAGEVSSSTSTSSTHCRFSSSNIMLID

SEQ ID NO: 741074 - protein, 110 aa, Homo sapiens
LKYIMLSLDSVPLQVTFTWPEHCSSSLCSFQVMPSRLPNLSLDVLFSGKFIHLLCVRCCSRPWGCSREEDKVTAFGEELSSSESKLPPSAVSTSRYCFISLLSLFMKLFQ

SEQ ID NO: 741075 - protein, 112 aa, Homo sapiens
YFSFYSSFVLGVVRKVRRVELNEKKVDFCLFYAEQCLQKNQNRKNKMHSNGSLTLFGNEAFSSHRVVCRSENLPSFLLYVQLKFALAPKRRETGGCRKQGVESFIFLSFTFI

SEQ ID NO: 741076 - protein, 1146 aa, Homo sapiens
QVWGRQELQRPSPFHATRGTEDLGPGQLGVVRRAGRENETRNPKAAPEPCFPLHLRRAAMDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVCLQGLWKETLPPVYALELLTIFAWEQGCKKDAFSLAEGLRTVLGLIQQHQHLCVFWTVNYGFEDPAVGQFLQRQLKRPRPVILDPADPTWDLGNGAAWHWDLLAQEAASCYDHPCFLRGMGDPVQSWKGPGLPRAGCSGLGHPIQLDPNQKTPENSKSLNAVYPRAGSKPPSCPAPGPTGAASIVPSVPGMALDLSQIPTKELDRFIQDHLKPSPQFQEQVKKAIDIILRCLHENCVHKASRVSKGGSFGRGTDLRDGCDVELIIFLNCFTDYKDQGPRRAEILDEMRAHVESWWQDQVPSLSLQFPEQNVPEALQFQLVSTALKSWTDVSLLPAFDAVGQLSSGTKPNPQVYSRLLTSGCQEGEHKACFAELRRNFMNIRPVKLKNLILLVKHWYRQVAAQNKGKGPAPASLPPAYALELLTIFAWEQGCRQDCFNMAQGFRTVLGLVQQHQQLCVYWTVNYSTEDPAMRMHLLGQLRKPRPLVLDPADPTWNVGHGSWELLAQEAAALGMQACFLSRDGTSVQPWDVMPALLYQTPAGDLDKFISEFLQPNRQFLAQVNKAVDTICSFLKENCFRNSPIKVIKVVKGGSSAKGTALRGRSDADLVVFLSCFSQFTEQGNKRAEIISEIRAQLEACQQERQFEVKFEVSKWENPRVLSFSLTSQTMLDQSVDFDVLPAFDALGQLVSGSRPSSQVYVDLIHSYSNAGEYSTCFTELQRDFIISRPTKLKSLIRLVKHWYQQCTKISKGRGSLPPQHGLELLTVYAWEQGGKDSQFNMAEGFRTVLELVTQYRQLCIYWTINYNAKDKTVGDFLKQQLQKPRPIILDPADPTGNLGHNARWDLLAKEAAACTSALCCMGRNGIPIQPWPVKAAV

SEQ ID NO: 741077 - protein, 282 aa, Homo sapiens
QVWGRQELQRPSPFHATRGTEDLGPGQLGVVRRAGRENETRNPKAAPEPCFPLHLRRAAMDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVKPLGRVSPDM

SEQ ID NO: 741078 - protein, 96 aa, Homo sapiens
AELGTNTALHPVSSVPSLNSQRFTPTGQAGSGVKPKPQVYSTLLNSGCQGGEHAACFTELRRNFVNIRPAKLKNLILLVKHWYHQVKPLGRVSPDM

SEQ ID NO: 741079 - protein, 1146 aa, Homo sapiens; identical to SEQ ID NO: 741076

SEQ ID NO: 741080 - protein, 1023 aa, Homo sapiens
QVWGRQELQRPSPFHATRGTEDLGPGQLGVVRRAGRENETRNPKAAPEPCFPLHLRRAAMDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVCLQGLWKETLPPVYALELLTIFAWEQGCKKDAFSLAEGLRTVLGLIQQHQHLCVFWTVNYGFEDPAVGQFLQRQLKRPRPVILDPADPTWDLGNGAAWHWDLLAQEAASCYDHPCFLRGMGDPVQSWKGPGLPRAGCSGLGHPIQLDPNQKTPENSKSLNAVYPRAGSKPPSCPAPGPTGAASIVPSVPGMALDLSQIPTKELDRFIQDHLKPSPQFQEQVKKAIDIILRCLHENCVHKASRVSKGGSFGRGTDLRDGCDVELIIFLNCFTDYKDQGPRRAEILDEMRAHVESWWQDQVPSLSLQFPEQNVPEALQFQLVSTALKSWTDVSLLPAFDAVGQLSSGTKPNPQVYSRLLTSGCQEGEHKACFAELRRNFMNIRPVKLKNLILLVKHWYRQVAAQNKGKGPAPASLPPAYALELLTIFAWEQGCRQDCFNMAQGFRTVLGLVQQHQQLCVYWTVNYSTEDPAMRMHLLGQLRKPRPLVLDPADPTWNVGHGSWELLAQEAAALGMQACFLSRDGTSVQPWDVMPALLYQTPAGDLDKFISEFLQPNRQFLAQVNKAVDTICSFLKENCFRNSPIKVIKVVKGGSSAKGTALRGRSDADLVVFLSCFSQFTEQGNKRAEIISEIRAQLEACQQERQFEVKFEVSKWENPRVLSFSLTSQTMLDQSVDFDVLPAFDALGQLVSGSRPSSQVYVDLIHSYSNAGEYSTCFTELQRDFIISRPTKLKSLIRLVKHWYQQVRHMDRPPS

SEQ ID NO: 741081 - protein, 482 aa, Homo sapiens
QVWGRQELQRPSPFHATRGTEDLGPGQLGVVRRAGRENETRNPKAAPEPCFPLHLRRAAMDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVCLQGLWKETLPPVYALELLTIFAWEQGCKKDAFSLAEGLRTVLGLIQQHQHLCVFWTVNYGFEDPAVGQFLQRQLKRPRPVILDPADPTWDLGNGAAWHWDLLAQEAASCYDHPCFLRGMGDPVQSWKGPVSEGAPGPLGFALCLCVQCFLSIYYVPYGVEQALKSRGGQVWWLTPVISTHWEAEVGRLPEVRGQEFETSLDNMVKPCLY

SEQ ID NO: 741082 - protein, 236 aa, Homo sapiens
QVWGRQELQRPSPFHATRGTEDLGPGQLGVVRRAGRENETRNPKAAPEPCFPLHLRRAAMDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGEGFLDHSRVGGKRSLGTTQDFQF

SEQ ID NO: 741083 - protein, 1146 aa, Homo sapiens; identical to SEQ ID NO: 741076

SEQ ID NO: 741084 - protein, 236 aa, Homo sapiens; identical to SEQ ID NO: 741082

SEQ ID NO: 741085 - protein, 640 aa, Homo sapiens
QVWGRQELQRPSPFHATRGTEDLGPGQLGVVRRAGRENETRNPKAAPEPCFPLHLRRAAMDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVCLQGLWKETLPPVYALELLTIFAWEQGCKKDAFSLAEGLRTVLGLIQQHQHLCVFWTVNYGFEDPAVGQFLQRQLKRPRPVILDPADPTWDLGNGAAWHWDLLAQEAASCYDHPCFLRGMGDPVQSWKGPGLPRAGCSGLGHPIQLDPNQKTPENSKSLNAVYPRAGSKPPSCPAPGPTGAASIVPSVPGMALDLSQIPTKELDRFIQDHLKPSPQFQEQVKKAIDIILRCLHENCVHKASRVSKGGSFGRGTDLRDGCDVELIIFLNCFTDYKDQGPRRAEILDEMRAHVESWWQDQVPSLSLQFPEQNVPEALQFQLVSTALKSWTDVSLLPAFDAVGQLSSGTKPNPQVYSRLLTSGCQEGEHKA

SEQ ID NO: 741086 - protein, 1065 aa, Homo sapiens
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 741087 - protein, 134 aa, Homo sapiens [sequence omitted]

SEQ ID NO: 741088 - protein, 1052 aa, Homo sapiens
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKQVSFLPPSEEVAFLPFAFQHDCKAS

SEQ ID NO: 741089 - protein, 1040 aa, Homo sapiens
MLEDISEEDIWEYKSKRKPKRVDPNNGSKNILKSVEKATDGKYQSKRSRNRKRAAEAKEVKDHEVPLGNAGCQTSVASSQNSSCGDGIQQTQDKETTPGKLCRTQKSQHVSPKIRPVYDGYCPNCQMPFSSLIGQTPRWHVFECLDSPPRSETECPDGLLCTSTIPFHYKRYTHFLLAQSRAGDHPFSSPSPASGGSFSETKSGVLCSLEERWSSYQNQTDNSVSNDPLLMTQYFKKSPSLTEASEKISTHIQTSQQALQFTDFVENDKLVGVALRLANNSEHINLPLPENDFSDCEISYSPLQSDEDTHDIDEKPDDSQEQLFFTESSKDGSLEEDDDSCGFFKKRHGPLLKDQDESCPKVNSFLTRDKYDEGLYRFNSLNDLSQPISQNNESTLPYDLACTGGDFVLFPPALAGKLAASVHQATKAKPDEPEFHSAQSNKQKQVIEESSVYNQVSLPLVKSLMLKPFESQVEGYLSSQPTQNTIRKLSSENLNAKNNTNSACFCRKALEGVPVGKATILNTENLSSTPAPKYLKILPSGLKYNARHPSTKVMKQMDIGVYFGLPPKRKEEKLLGESALEGINLNPVPSPNQKRSSQCKRKAEKSLSDLEFDASTLHESQLSVELSSERSQRQKKRCRKSNSLQEGACQKRSDHLINTESEAVNLSKVKVFTKSAHGGLQRGNKKIPESSNVGGSRKKTCPFYKKIPGTGFTVDAFQYGVVEGCTAYFLTHFHSDHYAGLSKHFTFPVYCSEITGNLLKNKLHVQEQYIHPLPLDTECIVNGVKVVLLDANHCPGAVMILFYLPNGTVILHTGDFRADPSMERSLLADQKVHMLYLDTTYCSPEYTFPSQQEVIRFAINTAFEAVTLNPHALVVCGTYSIGKEKVFLAIADVLGSKVGMSQEKYKTLQCLNIPEINSLITTDMCSSLVHLLPMMQINFKGLQSHLKKCGGKYNQILAFRPTGWTHSNKFTRIADVIPQTKGNISIYGIPYSEHSSYLEMKRFVQWLKPQKIIPTVNVGTWKSRSTMEKYFREWKLEAGY

SEQ ID NO: 741090 - protein, 1040 aa, Homo sapiens; identical to SEQ ID NO: 741089

SEQ ID NO: 741091 - protein, 1040 aa, Homo sapiens; identical to SEQ ID NO: 741089

SEQ ID NO: 741092 - protein, 104 aa, Homo sapiens
QLRGTHLRMLVFISTPASRVRSLDLELQSLSWASFLFCFITSSRTILDANEEFKSMSGTIQLGRKLITKYNRRELTDKLLIFLALALFLATVLYIVKKRLFPFL

SEQ ID NO: 741093 - protein, 237 aa, Homo sapiens
PLPVAGVPNMAAPQDVHVRICNQEIVKFDLEVKALIQDIRDCSGPLSALTELNTKVKEKFQQLRHRIQDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 741094 - protein, 246 aa, Homo sapiens
PLPVAGVPNMAAPQDVHVRICNQEIVKFDLEVKALIQDIRDCSGPLSALTELNTKVKEKFQQLRHRIQPVLYQRAFIWTASTFFFKLTYSLTDFSSTQHDFNSPTTPVTFSDLEQLAKEQDKESEKQLLLQEVENHKKQMLRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 741095 - protein, 237 aa, Homo sapiens; identical to SEQ ID NO: 741093

SEQ ID NO: 741096 - protein, 203 aa, Homo sapiens
PLPVAGVPNMAAPQDVHVRICNQEIVKFDLEVKALIQDIRDCSGPLSALTELNTKVKEKFQQLRHRIQDLEQLAKEQDKESEKQLLLQEVENHKKQMLRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 741097 - protein, 190 aa, Homo sapiens
AVPVRIPAIKEKFQQLRHRIQDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 741098 - protein, 140 aa, Homo sapiens
PLPVAGVPNMAAPQDVHVRICNQEIVKFDLEVKALIQDIRDCSGPLSALTELNTKVKEKFQQLRHRIQDLEQLAKEQDKESEKQLLLQEVENHKKQMLSNQASWRKANLTCKIAIDNLEKAELLQGGDLLRQRASWGSAG

SEQ ID NO: 741099 - protein, 239 aa, Homo sapiens
PLPVAGVPNMAAPQDVHVRICNQEIVKFDLEVKALIQDIRDCSGPLSALTELNTKVKEKFQQLRHRIQPVLYQRAFIWTASTFFFKLTYSLTDFSSTQHDFNSPTTPVTFSDLEQLAKEQDKESEKQLLLQEVENHKKQMLSNQASWRKANLTCKIAIDNLEKAELLQGGDLLRQRKTTKESLAQTSSTITESLMGISRMMAQQSLLHERSWMQMKNLSPCRAPSSWAGSLSQNTIAGS

SEQ ID NO: 741100 - protein, 187 aa, Homo sapiens
PLPVAGVPNMAAPQDVHVRICNQEIVKFDLEVKALIQDIRDCSGPLSALTELNTKVKEKFQQLRHRIQDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVPFKRCESEATGETA

SEQ ID NO: 741101 - protein, 280 aa, Homo sapiens
PLPVAGVPNMAAPQDVHVRICNQEIVKFDLEVKALIQDIRDCSGPLSALTELNTKVKEKFQQLRHRIQPVLYQRAFIWTASTFFFKLTYSLTDFSSTQHDFNSPTTPVTFSDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 741102 - protein, 104 aa, Homo sapiens; identical to SEQ ID NO: 741092

SEQ ID NO: 741103 - protein, 237 aa, Homo sapiens; identical to SEQ ID NO: 741093

SEQ ID NO: 741104 - protein, 225 aa, Homo sapiens
PLPVAGVPNMAAPQDVHVRICNQEIVKFDLEVKALIQVLIPGTLKEKFQQLRHRIQDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 741105 - protein, 237 aa, Homo sapiens; identical to SEQ ID NO: 741093

SEQ ID NO: 741106 - protein, 227 aa, Homo sapiens
PLPVAGVPNMAAPQDVHVRICNQEIVKFDLEVKALIQDIRDCSGPLSALTELNTKVKEKFQQLRHRIQDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFDLSWFLSSRLLS

SEQ ID NO: 741107 - protein, 378 aa, Homo sapiens
MQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLLTSHRLDPWKMQEAWKLVGGSDGERTAPFCSWFQGVLGILRCRAIAWLQS

SEQ ID NO: 741108 - protein, 378 aa, Homo sapiens; identical to SEQ ID NO: 741107

SEQ ID NO: 741109 - protein, 341 aa, Homo sapiens
MQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLGILRCRAIAWLQS

SEQ ID NO: 741110 - protein, 422 aa, Homo sapiens
MQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 741111 - protein, 422 aa, Homo sapiens; identical to SEQ ID NO: 741110

SEQ ID NO: 741112 - protein, 422 aa, Homo sapiens; identical to SEQ ID NO: 741110

SEQ ID NO: 741113 - protein, 405 aa, Homo sapiens
MQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQVKTKELLSPGYPLEVVFYLPLSLQGYSSVCYSLSLQLQCGGGAQWAS

SEQ ID NO: 741114 - protein, 255 aa, Homo sapiens
MQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQAIPQYAIPCHSSSNVVVEPSGLLELNNFTSQQLDDEETAMEQDIDSSTEDGTEPSPSQSSAERS

SEQ ID NO: 741115 - protein, 422 aa, Homo sapiens; identical to SEQ ID NO: 741110

SEQ ID NO: 741116 - protein, 78 aa, Homo sapiens
KKLEDDPKFLKSGDAAIVDMVLGEHMCVESFSDYPPRGRFAVRDMRQTVAVGVIKAVDKKAAGAGKVTKSAQKAQKAK

SEQ ID NO: 741117 - protein, 516 aa, Homo sapiens
MGLHFKWPLGAPMLAAIYAMSMVLKMLPALGMACPPKCRCEKLLFYCDSQGFHSVPNATDKGSLGLSLRHNHITELERDQFASFSQLTWLHLDHNQISTVKEDAFQGLYKLKELILSSNKIFYLPNTTFTQLINLQNLDLSFNQLSSLHPELFYGLRKLQTLHLRSNSLRTIPVRLFWDCRSLEFLDLSTNRLRSLARNGFAGLIKLRELHLEHNQLTKINFAHFLRLSSLHTLFLQWNKISNLTCGMEWTWGTLEKLDLTGNEIKAIDLTVFETMPNLKILLMDNNKLNSLDSKILNSLRSLTTVGLSGNLWECSARICALASWLGSFQGRWEHSILCHSPDHTQGEDILDAVHGFQLCWNLSTTVTVMATTYRDPTTEYTKRISSSSYHVGDKEIPTTAGIAVTTEEHFPEPDNAIFTQRVITGTMALLFSFFFIIFIVFISRKCCPPTLRRIRQCSMVQNHRQLRSQTRLHMSNMSDQGPYNEYEPTHEGPFIIINGYGQCKCQQLPYKECEV

SEQ ID NO: 741118 - protein, 109 aa, Homo sapiens
MKRVEADSAPVLKSRSCSLRTDGKRTKRVENPAVQPFPSKHASQPLRRLRQEDHLSPGGQGCSEPWSPLHSILGDRVRHRFQKNSTEMLYLQIYIISFGNRFKNFLRMR

SEQ ID NO: 741119 - protein, 433 aa, Homo sapiens
MLELIEVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 741120 - protein, 370 aa, Homo sapiens
MLELIEVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNVSDSHHFLCSLLTFLLKISCRFSNVIASF

SEQ ID NO: 741121 - protein, 729 aa, Homo sapiens
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 741122 - protein, 433 aa, Homo sapiens; identical to SEQ ID NO: 741119

SEQ ID NO: 741123 - protein, 352 aa, Homo sapiens
SPWVVAPDFALKPLESFLWGLELQDPIKATTEGHWAFIATKGLLVPADSGHAPPCPTPPFPGCQALSKRHLRPSGLPRPSLAAQALTKAASGLPPQAQGRSWLLASGCLLGRWGWSLAGLSSTLSASWQVLSCTSLPGQRAETRATGGTSDVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPVSPSSKPCCLQATGPKPALALARGVPPKAGHPSAVPRKLARAALPLLSN

SEQ ID NO: 741124 - protein, 300 aa, Homo sapiens
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKPRCGWSRCVPTWGWGCRSRIQASGQPLWPMPWLFPGPSRASWTPTACGGVVSPTS

SEQ ID NO: 741125 - protein, 300 aa, Homo sapiens; identical to SEQ ID NO: 741124

SEQ ID NO: 741126 - protein, 300 aa, Homo sapiens; identical to SEQ ID NO: 741124

SEQ ID NO: 741127 - protein, 300 aa, Homo sapiens; identical to SEQ ID NO: 741124

SEQ ID NO: 741128 - protein, 300 aa, Homo sapiens; identical to SEQ ID NO: 741124

SEQ ID NO: 741129 - protein, 300 aa, Homo sapiens; identical to SEQ ID NO: 741124

SEQ ID NO: 741130 - protein, 300 aa, Homo sapiens; identical to SEQ ID NO: 741124

SEQ ID NO: 741131 - protein, 300 aa, Homo sapiens; identical to SEQ ID NO: 741124

SEQ ID NO: 741132 - protein, 311 aa, Homo sapiens
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKPRCGWSRCVPTWGWGCRSRIQASGQPLWPMPWLFPGPSRASWTPTACGAMRAAPQATPLMEPHLVC

SEQ ID NO: 741133 - protein, 350 aa, Homo sapiens
MAAEQDPEARAAARPLLTDLYQATMALGYWRAGRARDAAEFELFFRRCPFGGAFALAAGLRDCVRFLRAFRLRDAGSPPSARRAPHARQKPPPMAGGSPCPPVEPPMSHDRSVPALVSAQFTSFPDVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKPRCGWSRCVPTWGWGCRSRIQASGQPLWPMPWLFPGPSRASWTPTACGGVVSPTS

SEQ ID NO: 741134 - protein, 196 aa, Homo sapiens
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGDVGASSW

SEQ ID NO: 741135 - protein, 273 aa, Homo sapiens
SPLLHRHTCTGPTPAPATPGLGPPGPPQALTSCWRQHLWNRVGEEWGPDVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKPRCGWSRCVPTWGWGCRSRIQASGQPLWPMPWLFPGPSRASWTPTACGGVVSPTS

SEQ ID NO: 741136 - protein, 196 aa, Homo sapiens; identical to SEQ ID NO: 741134

SEQ ID NO: 741137 - protein, 133 aa, Homo sapiens [sequence omitted]

SEQ ID NO: 741138 - protein, 213 aa, Homo sapiens
QACRVGETTPSNTLYAFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQVEPLLRLCLQQGQLCEPLPSLAESRALAQLSLSRLSPEHRRLRSPAQYQVVLSERLQALVNSLCAGQSP

SEQ ID NO: 741139 - protein, 256 aa, Homo sapiens
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGECLVRGKARAGKEEPHLGPRSPNPTAFLPRLRQQQQRASGPAARCAGGRDPGPLLRHFLFRQRGAP

SEQ ID NO: 741140 - protein, 197 aa, Homo sapiens
EFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTASMLADFIDCPPDDEKPPPPTEPDS

SEQ ID NO: 741141 - protein, 325 aa, Homo sapiens
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIPVNGPRESLSLPTSYLDFLLLPIVEDKMESIRVTSDKCIVY

SEQ ID NO: 741142 - protein, 212 aa, Homo sapiens
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGYWV

SEQ ID NO: 741143 - protein, 524 aa, Homo sapiens
MDTESTYSGYSYYSSHSKKSHRQGERTRERHKSPRNKDGRGSEKSVTIQPPTGEPLLGNDSTRTEEVQDDNWGETTTAITGTSEHSISQEDIARISKDMEDSVGLDCKRYLGLTVASFLGLLVFLTPIAFILLPPILWRDELEPCGTICEGLFISMAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 741144 - protein, 295 aa, Homo sapiens
MLCCWFPWRILAAGQVPYSPHSPQVAGCDLTRCESGGARALSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 741145 - protein, 219 aa, Homo sapiens [sequence omitted]

SEQ ID NO: 741146 - protein, 271 aa, Homo sapiens
MDTESTYSGYSYYSSHSKKSHRQGERTRERHKSPRNKDGRGSEKSVTIQPPTGEPLLGNDSTRTEEVQDDNWGETTTAITGTSEHSISQEDIARISKDMEDSVGLDCKRYLGLTVASFLGLLVFLTPIAFILLPPILWRDELEPCGTICEGLFISMAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGHLR

SEQ ID NO: 741147 - protein, 80 aa, Homo sapiens
LSVRGGLQAPGTHPPRHQDAQEEGHEGTIKEEPKRRLAQLSAKPAPAKVEAKLKKAAAKDKSSGKNVHSVRSVVVVVLFS

SEQ ID NO: 741148 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 741149 - protein, 380 aa, Homo sapiens; identical to SEQ ID NO: 741148

SEQ ID NO: 741150 - protein, 381 aa, Homo sapiens
RIVLGLVAKMASSASARTPAGKRVINQEELRRLMKEKQRLSTSRKRIESPFAKYNRLGQLSCALCNTPVKSELLWQTHVLGKQHREKVAELKGAKEASQGSSASSAPQSVKRKAPDADDQDVKRAKATLVPQVQPSTSAWTTNFDKIGKEFIRATPSKPSGLSLLPDYEDEEEEEEEEEGDGERKRGDASKPLSDAQGKEHSVSSSREVTSSVLPNDFFSTNPPKAPIIPHSGSIEKAEIHEKVVERRENTAEALPEGFFDDPEVDARVRKVDAPKDQMDKEWDEFQKAMRQVNTISEAIVAEEDEEGRLDRQIGEIDEQIECYRRVEKLRNRQDEIKNKLKEILTIKELQKKEEENADSDDEGELQDLLSQDWRVKGALL

SEQ ID NO: 741151 - protein, 101 aa, Homo sapiens
RIVLGLVAKMASSASARTPAGKRVINQEELRRLMKEIDEQIECYRRVEKLRNRQDEIKNKLKEILTIKELQKKEEENADSDDEGELQDLLSQDWRVKGALL

SEQ ID NO: 741152 - protein, 381 aa, Homo sapiens; identical to SEQ ID NO: 741150

SEQ ID NO: 741153 - protein, 381 aa, Homo sapiens; identical to SEQ ID NO: 741150

SEQ ID NO: 741154 - protein, 149 aa, Homo sapiens
IHFSISHTFYTIDSKEALSTWFSFGSEKPTTKNLRGARGHEGHLLAPLSPGLACRKRERDSGLPGPGNPRRPGNGGFPCHPQPQLELLGRKACARCSAGRSGSSHGCSTCFPSPRIFNGGLQQSPTRPFSGCPHSRPAFPEGLSSGVVL

SEQ ID NO: 741155 - protein, 129 aa, Homo sapiens
TPRTAQLSPLVSPPTRHHRSWGCVWRVCALWGEFQEAPPLLKLGAWRAVPVRAGAEARSVFEGTPPPPPPQFLPRVSCPGCVRGRGFPCASSCTSRSVSGGREEDWGSRLLLGDVSGAGDPGCARGRRP

SEQ ID NO: 741156 - protein, 71 aa, Homo sapiens
LPCPQTPRARDTGRRPGHQASSRNRLAPESRLGLQSPLLPSLRSAPCPPLPALLASKPNFAFHPERLIPRR

SEQ ID NO: 741157 - protein, 106 aa, Homo sapiens
LWSNAIFAGYKQDLWNQREHTPLLKIEVVYARDETEFYLGKRCAYVYKAKNNPVTPGSKPNKTRVIGGKVTHAHGNSGLVRAKFRSNLPAKAIGHRIRVMLYPSRI

SEQ ID NO: 741158 - protein, 68 aa, Homo sapiens
HYRECISSSKCFACLTYNASFQRWEQNQLCSVLYWYLNNKMKEKKRKKKEEEENKKKKRKKKRRRKKK

SEQ ID NO: 741159 - protein, 622 aa, Homo sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDALPTRPKKRARSVERASTPYSIDSDSLGMECIISGSASPTLAINTVTNKVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 741160 - protein, 622 aa, Homo sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDVLPTRPKKRARSVERASTPYSIDSDSLGMECIISGSASPTLAINTVTNKVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 741161 - protein, 588 aa, Homo sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDALPTRPKKRARSVERVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 741162 - protein, 588 aa, Homo sapiens; identical to SEQ ID NO: 741161

SEQ ID NO: 741163 - protein, 497 aa, Homo sapiens
HRQLYSGLRSLRFSLWPDGFVWTGLSICNFIKNSIRHNLSLNKCFLKVPRSKDDPGKGSYWAIDTNPKEDALPTRPKKRARSVERVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 741164 - protein, 433 aa, Homo sapiens
MECIISGSASPTLAINTVTNKVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 741165 - protein, 430 aa, Homo sapiens
GGLEDPISGQDEGRSVERVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 741166 - protein, 348 aa, Homo sapiens
KGSEMRHYRSSKYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 741167 - protein, 588 aa, Homo sapiens; identical to SEQ ID NO: 741161

SEQ ID NO: 741168 - protein, 145 aa, Homo sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKISYLFIYWYCNVKSSIKFDITR

SEQ ID NO: 741169 - protein, 351 aa, Homo sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDALPTRPKKRARSVERVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQAAYAIELLTRD

SEQ ID NO: 741170 - protein, 168 aa, Homo sapiens [sequence omitted]

SEQ ID NO: 741171 - protein, 50 aa, Homo sapiens
MAVASTPQAVIRLHRSHCLTPRCTHSHLHILPIDRMVYRSIRSVPHTQHH

SEQ ID NO: 741172 - protein, 106 aa, Homo sapiens
ELEPEPRESRLPGAADMEGQSSRGSRRPGTRAGLGSLPMPQGVAQTGAPSKTEKLRRWAERYLPKVTQSWALNLHSQSQLPALAPEWSSGNGWTQVFSSQQRRTQP

SEQ ID NO: 741173 - protein, 146 aa, Homo sapiens
ELEPEPRESRLPGAADMEGQSSRGSRRPGTRAGLGSLPMPQGVAQTGAPSKVDSSFQLPAKKNAALGPSEPRLALAPVGPRAAMSASSEGPRLALASPRPILAPLCTPEGQKTATAHRSSSLAPTSVGQLVMSASAGPKPPPATTG

SEQ ID NO: 741174 - protein, 454 aa, Homo sapiens
MLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 741175 - protein, 501 aa, Homo sapiens
ELEPEPRESRLPGAADMEGQSSRGSRRPGTRAGLGSLPMPQGVAQTGAPSKVDSSFQLPAKKNAALGPSEPRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSIRSGKMIDEGVIMKGDKLFYASVAG

SEQ ID NO: 741176 - protein, 267 aa, Homo sapiens
ELEPEPRESRLPGAADMEGQSSRGSRRPGTRAGLGSLPMPQGVAQTGAPSKVDSSFQLPAKKNAALGPSEPRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFRDLNFRYYEQWGTLDQHT

SEQ ID NO: 741177 - protein, 237 aa, Homo sapiens
SWSRSQGSPGCRGLQTWRARAAGAAGGQGPGLAWVPCPCPRVLPKLGHPPRITVVTWNVGTAMPPDDVTSLLHLGGGDDSDGADMIAIGLQEVNSMLNKRLKDALFTDQWSELFMDALGPFNFVLVTHPSPPGQPETLLNSWLQLYPGSLWGPLGLCGWVRDMGGWRSRPEGGREGGGVVFCPPATWPPAAGEFGEDAGCHPAAVRQVLPPALPARRADRLHAHWPGRLLGEPVSRP

SEQ ID NO: 741178 - protein, 654 aa, Homo sapiens
ELEPEPRESRLPGAADMEGQSSRGSRRPGTRAGLGSLPMPQGVAQTGAPSKVDSSFQLPAKKNAALGPSEPRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 741179 - protein, 681 aa, Homo sapiens
ELEPEPRESRLPGAADMEGQSSRGSRRPGTRAGLGSLPMPQGVAQTGAPSKVDSSFQLPAKKNAALGPSEPRITVVTWNVGTAMPPDDVTSLLHLGGGDDSDGADMIAIGLQEVNSMLNKRLKDALFTDQWSELFMDALGPFNFVLVTHPSPPGQPETLLNSWLQLYPGSLWGPLGLCGWVRDMVGGGADLKVGARAGELCSVPQPRGLPLQGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 741180 - protein, 106 aa, Homo sapiens
VSRSQLVIITPYKYNNFARDPYCPVCPKSYCYCTPFVLKDFATGIGGDFFFFETESRSVAQAGVQWRDLGSLQAPPPGFTPFSCLSLPSSWDYRRPPPRPANFLYF

SEQ ID NO: 741181 - protein, 81 aa, Homo sapiens
FRIQGLFLFALIIQRTMNQAFSLCCHCILPFPPSVIDPCHSHCNLIERETVTLKKEIEDRLTPWKLRQTDKKNGRNTENDR

SEQ ID NO: 741182 - protein, 132 aa, Homo sapiens
MLIEDVDALKSWLAKLLEPICDADPSALANYVVALVKKDKPEKELKAFCADQLDVFLQKETSGFVDKLFESLYTKNYLPLLEPVKPEPKPLVQEKEEIKEEVFQEPAEEERDGRKKKYPSPQKTRSESSERR

SEQ ID NO: 741183 - protein, 413 aa, Homo sapiens
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTIEQLKQKADKRVRSVRYKVIEDYSGACCPLNKGIKTFFTSPCTEEPRIQLQKGEFILATRGLRYWLYGDKILDDSFIEGVSRIRGWFPRKCVEKCPCDAETDQAPEGEKKNR

SEQ ID NO: 741184 - protein, 413 aa, Homo sapiens; identical to SEQ ID NO: 741183

SEQ ID NO: 741185 - protein, 317 aa, Homo sapiens
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTFVCHVSTESVNLSVFT

SEQ ID NO: 741186 - protein, 263 aa, Homo sapiens
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRMKIILRNKTSIESWIEEKAKDRIQYYQLDEVFVFPYDMGSRWRNFKQVFTWSGVPEGDGLEWPVREGCHQYSLTFVCHVSTESVNLSVFT

SEQ ID NO: 741187 - protein, 446 aa, Homo sapiens
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTFVCHVSTESVNLSVFTMRSFMRAENILPDPWATIEQLKQKADKRVRSVRYKVIEDYSGACCPLNKGIKTFFTSPCTEEPRIQLQKGEFILATRGLRYWLYGDKILDDSFIEGVSRIRGWFPRKCVEKCPCDAETDQAPEGEKKNR

SEQ ID NO: 741188 - protein, 413 aa, Homo sapiens; identical to SEQ ID NO: 741183

SEQ ID NO: 741189 - protein, 413 aa, Homo sapiens; identical to SEQ ID NO: 741183

SEQ ID NO: 741190 - protein, 317 aa, Homo sapiens; identical to SEQ ID NO: 741185

SEQ ID NO: 741191 - protein, 151 aa, Homo sapiens
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMHCPWFKPLHSSLGDKRKTLSPQKEKH

SEQ ID NO: 741192 - protein, 413 aa, Homo sapiens; identical to SEQ ID NO: 741183

SEQ ID NO: 741193 - protein, 413 aa, Homo sapiens; identical to SEQ ID NO: 741183

SEQ ID NO: 741194 - protein, 413 aa, Homo sapiens; identical to SEQ ID NO: 741183

SEQ ID NO: 741195 - protein, 317 aa, Homo sapiens; identical to SEQ ID NO: 741185

SEQ ID NO: 741196 - protein, 90 aa, Homo sapiens
DEQNDTQKQFCEEQNTGILHDEILIHEEKQIEVVEKMNSELSLSCKKEKDFLHENSTLREEIAMLRLELDTMKHQSQLRKKKYLEDIESV

SEQ ID NO: 741197 - protein, 139 aa, Homo sapiens
QSRKLRNYITDLMSRARELTCSSPSLVPSPFTKIQMPPSGSLHEKVEAAREALARETTQRRRPQRKFALVQELSGQALGAGWERKLMSSYGGASSLHEDSELLQAESHLSHHVGHNVTHSGSIESIIRVGLPQTSFTST

SEQ ID NO: 741198 - protein, 464 aa, Homo sapiens
LTRWRDPQGFTSNYPSAGEGSAASKAALPFSKRRAKRRSFSTNIRAMAQESVMFSDVSVDFSQEEWECLNDDQRDLYRDVMLENYSNLVSMGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 741199 - protein, 367 aa, Homo sapiens
LTRWRDPQGFTSNYPSAGEGSAASKAVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 741200 - protein, 445 aa, Homo sapiens
SALCGGGALPFSKRRAKRRSFSTNIRAMAQESVMFSDVSVDFSQEEWECLNDDQRDLYRDVMLENYSNLVSMGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 741201 - protein, 390 aa, Homo sapiens
THALAGPSGLYQQLPQCRGGFCCFESCSTLLQKKSQEKVLFYKYQSHGSVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 741202 - protein, 349 aa, Homo sapiens
LTRWRDPQGFTSNYPSAGEGSAASKAALPFSKRRAKRRSFSTNIRAMAQESVMFSDVSVDFSQEEWECLNDDQRDLYRDVMLENYSNLVSMGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTEKWITIHFPEICFFTFNCTFWIFLQ

SEQ ID NO: 741203 - protein, 136 aa, Homo sapiens
MQRQEGHRCSRCPRQPEAAGIQQQRGWAWNGPPEAGQRPGSWERLGRPGEGAAPAEAPPGSSSETLQAGGGFLGQCHPRQAPGAHRPPGHSGSSSGQGGRAECKPLLRRQTRRHEQVRRELPPAGRPRTLASASMS

SEQ ID NO: 741204 - protein, 106 aa, Homo sapiens
ILHLHWKPRRVLHMPETMRTLCEVQSMQDQVREGPSGPAPKPPRLGEAWTHESNSSPKQERIIRLDPWEAGCKTAELSQDVSPCSPIPPGHSKAQHALKGTVSQPR

SEQ ID NO: 741205 - protein, 186 aa, Homo sapiens
LPTREQKRRGPAGEEETGVSAPELGLWNGVGAVVCSIAGSSLGGTLLAKHWKLLPLLRSVLRFRLGGLACQTALVFHLDTLGASMDAGTILRGSALLSLCLQHFLGGLVTTVTFTGMMRCSQLAPRALQATHYSLLATLELLGKLLLGTLAGGLADGLGPHPCFLLLLILSAFPVLYLDLAPSTFL

SEQ ID NO: 741206 - protein, 163 aa, Homo sapiens
MASTRPRVHVVCSIAGSSLGGTLLAKHWKLLPLLRSVLRFRLGGLACQTALVFHLDTLGASMDAGTILRGSALLSLCLQHFLGGLVTTVTFTGMMRCSQLAPRALQATHYSLLATLELLGKLLLGTLAGGLADGLGPHPCFLLLLILSAFPVLYLDLAPSTFL

SEQ ID NO: 741207 - protein, 412 aa, Homo sapiens
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWPQLFLLLAATYWLAAALAWAAPALRRLPQQPPSEQRPHTAHLLRDVLAVPGTVWTAGFVLTYKLGEQGASSLFPLLLLDHGVSAPELGLWNGVGAVVCSIAGSSLGGTLLAKHWKLLPLLRSVLRFRLGGLACQTALVFHLDTLGASMDAGTILRGSALLSLCLQHFLGGLVTTVTFTGMMRCSQLAPRALQATHYSLLATLELLGKLLLGTLAGGLADGLGPHPCFLLLLILSAFPVLYLDLAPSTFL

SEQ ID NO: 741208 - protein, 233 aa, Homo sapiens
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWPQLFLLLAATYWLAAALAWAAPALRRLPQQPPSEQRPHTAHLLRDVLAVPGTVWTAGFVLTYKLGNCCLC

SEQ ID NO: 741209 - protein, 433 aa, Homo sapiens
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWPQLFLLLAATYWLAAALAWAAPALRRLPQQPPSEQRPHTAHLLRDVLAVPGTVWTAGFVLTYKLGEQGASSLFPLLLLDHGVSAPELGLWNGVGAVVCSIAGSSLGGTLLAKHWKLLPLLRSVLRFRLGGLACQTALVFHLDTLGASMDAGTILRGSALLSLCLQHFLGGLVTTVTFTGMMRCSQLAPRALQVSRCSRDTRETTGLGLCGPDLDRDPHPPPHTTAFWPRWSCWGSCCWALWPEAWLMGWGHIPASCSCSSSLPFPFCTWT

SEQ ID NO: 741210 - protein, 436 aa, Homo sapiens
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWPQLFLLLAATYWLAAALAWAAPALRRLPQQPPSEQRPHTAHLLRDVLAVPGTVWTAGFVLTYKLGEQGASSLFPLLLLDHGVSAPELGLWNGVGAVVCSIAGSSLGGTLLAKHWKLLPLLRSVLRFRLGGLACQTALVFHLDTLGASMDAGTILRGEGLALEEEERGQEPGALLTSALPGSALLSLCLQHFLGGLVTTVTFTGMMRCSQLAPRALQATHYSLLATLELLGKLLLGTLAGGLADGLGPHPCFLLLLILSAFPVLYLDLAPSTFL

SEQ ID NO: 741211 - protein, 328 aa, Homo sapiens
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWPQLFLLLAATYWLAAALAWAAPALRRLPQQPPSEQRPHTAHLLRDVLAVPGTVWTAGFVLTYKLGEQGASSLFPLLLLDHGVSAPELGLWNGVGAVVCSIAGSSLGGTLLAKHWKLLPLLRSVLRFRLGGLACQTALVFRHTLQPSGHAGAAGEAAAGHSGRRPG

SEQ ID NO: 741212 - protein, 233 aa, Homo sapiens; identical to SEQ ID NO: 741208

SEQ ID NO: 741213 - protein, 216 aa, Homo sapiens
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWRIFCLVHYGGGLAGDSLGSQSPSRVPPALGLYRRAVRGVAQHGARLFGQVHGE

SEQ ID NO: 741214 - protein, 196 aa, Homo sapiens
SPRVKAAGLLLLSGRDAGSPEEYVIVLSCQWTALFPYQYEVIRFPHDNVVVSPTPTPQKHWKLLPLLRSVLRFRLGGLACQTALVFHLDTLGASMDAGTILRGSALLSLCLQHFLGGLVTTVTFTGMMRCSQLAPRALQATHYSLLATLELLGKLLLGTLAGGLADGLGPHPCFLLLLILSAFPVLYLDLAPSTFL

SEQ ID NO: 741215 - protein, 123 aa, Homo sapiens
LQLWNTEESRAGLRAQVGRREVGADMEPPVLMPPPPPKVSRVPAACFLFSCWTTAFLLPSWDCGMVWVLWSAPSLAPPWVGPCWPSTGEPSPVYPAHPLVPELPPIHYTDPFPTPIPGNCCLC

SEQ ID NO: 741216 - protein, 224 aa, Homo sapiens [sequence omitted]

SEQ ID NO: 741217 - protein, 145 aa, Homo sapiens
MGCGGSRADAIEPRYYESWTRETESTWLTYTDSDAPPSAAAPDSGPEAGGLHSGMLEDGLPSNGVPRSTAPGGIPNPEKKTNCETQCPNPQSLSSGPLTQKQNGLQTTEAKRDAKRMPAKEVTINVTDSIQQMDRSRRITKNCVN

SEQ ID NO: 741218 - protein, 224 aa, Homo sapiens [sequence omitted]

SEQ ID NO: 741219 - protein, 259 aa, Homo sapiens
MGTGGEGGPWRRRGGTGWERARTRGGGHRRSSARLQRGRERGRDVAAAASLRAGAAPPGLSRRQSRQPSSRWALPRRRRMGCGGSRADAIEPRYYESWTRETESTWLTYTDSDAPPSAAAPDSGPEAGGLHSVLEAEKSKIKAPTDSVSDEGLFSASKMAPLAVFSHGMLEDGLPSNGVPRSTAPGGIPNPEKKTNCETQCPNPQSLSSGPLTQKQNGLQTTEAKRDAKRMPAKEVTINVTDSIQQMDRSRRITKNCVN

SEQ ID NO: 741220 - protein, 215 aa, Homo sapiens
MKISENLQEPKNSSPPCCMPWSVVKENILFHSSSSALETQALHSKAPGIVHQHQQFSAKSISQNLFYLFQFLSFHRIVFLQVIADSHTALQIHVQLWSECAVFSQNSSLKLNPQCDSINSCGLLESEGGALVSGIRALIKEIEGSYLALPSLLPCEDTVFIPFVFPPFEDAERRCHLGSKEQPSPDTKSAGTLILDFPASRTVRNEFLLFINYLV

SEQ ID NO: 741221 - protein, 224 aa, Homo sapiens [sequence omitted]

SEQ ID NO: 741222 - protein, 191 aa, Homo sapiens
MGTGGEGGPWRRRGGTGWERARTRGGGHRRSSARLQRGRERGRDVAAAASLRAGAAPPGLSRRQSRQPSSRWALPRRRRMGCGGSRADAIEPRYYESWTRETESTWLTYTDSDAPPSAAAPDSGPEAGGLHSGMLEDGLPSNGVPRSTAPGGIPNPEKKTNCETQCPNPQSLSSGPLTQKQNGLQTTEVAF

SEQ ID NO: 741223 - protein, 106 aa, Homo sapiens
RWPGSVQCATRGLYRLSKNLEEMNPFQRPSKGSPAYTGISRNRNLGFILEVVEAFGGLNQDSTCGFPAMGSSFKRTSQALHPDCDVSSCSSLGCFWIASPMRTALK

SEQ ID NO: 741224 - protein, 224 aa, Homo sapiens [sequence omitted]

SEQ ID NO: 741225 - protein, 224 aa, Homo sapiens [sequence omitted]

SEQ ID NO: 741226 - protein, 106 aa, Homo sapiens; identical to SEQ ID NO: 741223

SEQ ID NO: 741227 - protein, 273 aa, Homo sapiens
ARGEEEGRGLEDTNMNKLKSSQKDKVRQFMIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 741228 - protein, 273 aa, Homo sapiens; identical to SEQ ID NO: 741227

SEQ ID NO: 741229 - protein, 206 aa, Homo sapiens
ELEARVNNKLKSSQKDKVRQFMIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLRNGHLSTGSLVLKWKNGKYFRLSGN

SEQ ID NO: 741230 - protein, 273 aa, Homo sapiens; identical to SEQ ID NO: 741227

SEQ ID NO: 741231 - protein, 244 aa, Homo sapiens
MIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 741232 - protein, 273 aa, Homo sapiens; identical to SEQ ID NO: 741227

SEQ ID NO: 741233 - protein, 134 aa, Homo sapiens
MTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 741234 - protein, 271 aa, Homo sapiens
TRGSTTRRGRVGRNKLKSSQKDKVRQFMIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 741235 - protein, 273 aa, Homo sapiens; identical to SEQ ID NO: 741227

SEQ ID NO: 741236 - protein, 245 aa, Homo sapiens
YIFILTMPEIPKIHEFEYEIQFESEAMKSKLESCVALYMIEKSYDIMAKRITFIFNLVFTPKKPLRSHITLKIECVTEGIWKFPIMLIATEPDTDAVIDIEGVGLFKESVFELRLKSQTRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 741237 - protein, 191 aa, Homo sapiens
YIFILTMPEIPKIHEFEYEIQFESEAMKSKLESCVALYMIEKSYDIMAKRITFIFNLVFTPKKPLRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 741238 - protein, 92 aa, Homo sapiens
TAFGPNLCQSVMYANSGYSINGRIKMCFNKGSHGFDNVLMDMKTFRAFGPDFKRNGLAEPFNDIHIYPFMCKLLGVTPKPTTAPWQSPRKCS

SEQ ID NO: 741239 - protein, 173 aa, Homo sapiens
MYANSGYSINGRIKMCFNKGSHGFDNVLMDMKTFRAFGPDFKRNGLAEPFNDIHIYPFMCKLLGVTPKPSNGSLAVTQEMLVNSYDQQPGETQKQLPENCQQSLLCPEIEKKQKVVSWWGGGNSSRTILIPSSFGALGTRCQQLQTDSTGGRESLDLLVTFDIVPFRQREGAL

SEQ ID NO: 741240 - protein, 149 aa, Homo sapiens
QARGEKGRQPAGAACVFECASVSECECRVLPLLVPPAEGPGGLGRAGGLLGGRGSKRRRRGEPRRRRRREERAEQPLLRETLQTKKAPDSPRPPAPQAGPLAPGPRPSGHCNFPPGQRPPRGGPRLCVRVFVRPADWSSQSGLPVPLGT

SEQ ID NO: 741241 - protein, 145 aa, Homo sapiens
YEKSNCICNPTLSFIEGKEPQMTSQFCPPSACDSLSSSPTPMVCIFLTSPPQEQLSRMRGGEAPSLRERGEKGAALLLYFWFCFSWAGMGWERGSATFLQNLPSAPPTAYVIPHRISSTPAATFGRVLSQELREGVRKVDIPSQL

SEQ ID NO: 741242 - protein, 489 aa, Homo sapiens
RAHTQRPLAFLPGFLPVCSAPDRPLAAARGRPHRAEAGPGRRRAQRGPRAAAAAHARPVPARGGHRDSAGPPEAGDVKMSVGCACPGCSSKSFKLYSPKEPPNGNAFPPFHPGTMLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 741243 - protein, 316 aa, Homo sapiens
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPVSISAFFSLLGCPTTHP

SEQ ID NO: 741244 - protein, 437 aa, Homo sapiens
MFAHGLLWCLKCATCRKTSSLVTSVLSMDSWLRMSLGTSVLVRTESPDRVQRRFNPVSLTSAMLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 741245 - protein, 371 aa, Homo sapiens
MMWANSQCIRYNLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 741246 - protein, 375 aa, Homo sapiens
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 741247 - protein, 315 aa, Homo sapiens
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSGVNPGGGACGEPEIAPLHSSLGDRARLR

SEQ ID NO: 741248 - protein, 323 aa, Homo sapiens
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPHPCQDSSGVAVAPPYLSWCPQQRGPVAWGGRAGCSEAEAARGGGGEAEKEEEERGKSGAAIVEGNLANKEGSGLPAAPRPPGRPPGPRPTAQW

SEQ ID NO: 741249 - protein, 217 aa, Homo sapiens
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQ

SEQ ID NO: 741250 - protein, 181 aa, Homo sapiens
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHF

SEQ ID NO: 741251 - protein, 171 aa, Homo sapiens
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVSNPAGCGTPWHLGLIPILSPSVYSQLFPREA

SEQ ID NO: 741252 - protein, 375 aa, Homo sapiens; identical to SEQ ID NO: 741246

SEQ ID NO: 741253 - protein, 149 aa, Homo sapiens; identical to SEQ ID NO: 741240

SEQ ID NO: 741254 - protein, 467 aa, Homo sapiens
RGARRAPARPPPPPPHVSWQRASAGGGEQHELLKLSPRQPSPLPGLLWACSRSPVPLLAPSVLPGCSSKSFKLYSPKEPPNGNAFPPFHPGTMLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 741255 - protein, 375 aa, Homo sapiens; identical to SEQ ID NO: 741246

SEQ ID NO: 741256 - protein, 90 aa, Homo sapiens
GDSMLWFTVRVFSHPLPAGPPASWVYIVGLSMCPTAPTSQRGCFPGPDHDSHKEGLRARPLGLLWPGKLCVSVLIPSPAVSRVIGEFPQS

SEQ ID NO: 741257 - protein, 182 aa, Homo sapiens
MSQKPAKEGPRLSKNQKYSEHFSIHCCPPFTFLNSKKEIVDRKYSICKSGCFYQKKEEDWICCACQKTRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRF

SEQ ID NO: 741258 - protein, 182 aa, Homo sapiens; identical to SEQ ID NO: 741257

SEQ ID NO: 741259 - protein, 183 aa, Homo sapiens
MSQKPAKEGPRLSKNQKYSEHFSIHCCPPFTFLNSKKEIVDRKYSICKSGCFYQKKEEDWICCACQKTRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRFW

SEQ ID NO: 741260 - protein, 182 aa, Homo sapiens; identical to SEQ ID NO: 741257

SEQ ID NO: 741261 - protein, 182 aa, Homo sapiens; identical to SEQ ID NO: 741257

SEQ ID NO: 741262 - protein, 182 aa, Homo sapiens; identical to SEQ ID NO: 741257

SEQ ID NO: 741263 - protein, 227 aa, Homo sapiens
LRTPLFPLVGSGLGSDTGRHSRETGRWVGEQGLPTCFQLLPASLKQQRRALAPASSFFVALSEPAAVPSPLRGPSNSQLRPPRWSERQPSHGPLRGLSVSHGPLRGLSVSHGPLRGLSVSHGPLRGLSVSHVPAQRSDHRQPSSVPLRSPSNSRAAAPSEGQAPAVGGPPSKLLGSGNTISSLLFPSPKIEKEDQANPKEEVTKEEFKLNEQPRLLDSLLHNPSTPG

SEQ ID NO: 741264 - protein, 183 aa, Homo sapiens; identical to SEQ ID NO: 741259

SEQ ID NO: 741265 - protein, 134 aa, Homo sapiens [sequence omitted]

SEQ ID NO: 741266 - protein, 141 aa, Homo sapiens
METAGAATGQPASGLEAPGSTNDRLFLVKGGIFLGTVAAAGMLAGFITTLSLAKKKSPEWFNKGSMATAALPESGSSLALRALGWGSLYAWCGVGVISFAVWKALGVHSMNDFRSKMQSIFPTIPKNSESAVEWEETLKSK

SEQ ID NO: 741267 - protein, 138 aa, Homo sapiens
HEHSWTPEPPAQRPAAQLQRPLSPCLGGIFLGTVAAAGMLAGFITTLSLAKKKSPEWFNKGSMATAALPESGSSLALRALGWGSLYAWCGVGVISFAVWKALGVHSMNDFRSKMQSIFPTIPKNSESAVEWEETLKSK

SEQ ID NO: 741268 - protein, 190 aa, Homo sapiens
METAGAATGQPASGLEAPGSTNDRLFLVKGGIFLGTVAAAGMLAGFITTLSLAKKKSPEWFNKGSMATAALPESGSSLALRALGWGSLYAWCGVGVISFAVWKALGVHSNFLKKLEQSFMCVCCQELVYQPVTTECFHNVCKDCLQRSFKAQVFSCPAAGMIFGQNYIMIPNEILQTLLDLFFPGYSKGR

SEQ ID NO: 741269 - protein, 455 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGAHPKASHRAWDRAARCQLAYLTVPGALPPPSQDGLDLGNRAGWGCSPECLSKAPGGEGPAQAHPGPNPHTTENPNGAETVARPRLAPPHPGGRWHFLTCTVLLYQETRPAPVS

SEQ ID NO: 741270 - protein, 49 aa, Homo sapiens
MFCPQNRGKGGAVSKLMESMAAEEDFEPNQDSSFSEDEHLPRGGAVERP

SEQ ID NO: 741271 - protein, 105 aa, Homo sapiens
MAPLCCFLLQKKKGKEAGPGAGLPPPRAPALPSEARAPHASSLTAAKRSKAKAKGKEVKKENRGKGGAVSKLMESMAAEEDFEPNQDSSFSEDEHLPRGGAVERP

SEQ ID NO: 741272 - protein, 1361 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPPSSSSSSSSSSSSSSSSSSSSSSSSSSSSSSSSSSSSSSSSSSSSSSSSSSTTDEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 741273 - protein, 399 aa, Homo sapiens
MLSHFSFCTYMLHFWLIMEENLQHYTVKLGCIHPFKWHQYRCRHPCCLTLQSQLSVHWQPSNTPSSSSSSSSSSSSSSSSSSSSSSSSSSSSSSSSSSSSSSTTDEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 741274 - protein, 826 aa, Homo sapiens
RPLTPAPRSCIIDKDELKDGLRVLIPMDDKLLYAGHVQTVHSPDIYRVVVEGERGNRPHIYCLEQLLQEAIIDVRPASTRFLPQGTRIAAYWSQQYRCLYPGTVVRGLLDLEDDGDLITVEFDDGDTGRIPLSHIRLLPPDYKIQCAEPSPALLVPSAKRRSRKTSKDTGEGKDGGTAGSEEPGAKARGRGRKPSAKAKGDRAATLEEGNPTDEVPSTPLALEPSSTPGSKKSPPEPVDKRAKAPKARPAPPQPSPAPPAFTSCPAPEPFAELPAPATSLAPAPLITMPATRPKPKKARAAEESGAKGPRRPGEEAELLVKLDHEGVTSPKSKKAKEALLLREDPGAGGWQEPKSLLSLGSYPPAAGSSEPKAPWPKATDGDLAQEPGPGLTFEDSGNPKSPDKAQAEQDGAEESESSSSSSSGSSSSSSSSSSSGSETEGEEEGDKNGDGGCGTGGRNCSAASSRAAFTGLLLLLLILVLLLLLLLILLFLLLLFLLLLFLFVFLLFLLLLFLVLILLLLLLFLLFFLHHSEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 741275 - protein, 186 aa, Homo sapiens
MPDRLWKCFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 741276 - protein, 107 aa, Homo sapiens
ERSGRCREIPGGMGPGVHVDARVSVCACTCVHACAHASSPTFQPLSAPRTGAPLSYQGMAGPALPAQHVASTWPGRPSRLLLRGGPGAPRSMQTGDSVGRGASKEPN

SEQ ID NO: 741277 - protein, 761 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQGY

SEQ ID NO: 741278 - protein, 1091 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKVPATVSKGRHWKKKGKEAGPGAGLPPPRAPALPSEARAPHASSLTAAKRSKAKAKGKEVKKENRGKGGAVSKLMESMAAEEDFEPNQDSSFSEDEHLPRGGAVERP

SEQ ID NO: 741279 - protein, 1018 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKVGAALGGGAAEGSLGFREGGALSPPSLGKRLHC

SEQ ID NO: 741280 - protein, 1018 aa, Homo sapiens; identical to SEQ ID NO: 741279

SEQ ID NO: 741281 - protein, 697 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYITFSAHPETPGLVRALFGHGFGGGFPRNIL

SEQ ID NO: 741282 - protein, 399 aa, Homo sapiens; identical to SEQ ID NO: 741273

SEQ ID NO: 741283 - protein, 386 aa, Homo sapiens
MAPLCCFLLQKKKGKEAGPGAGLPPPRAPALPSEARAPPSSSSSSSSSSSSSSSSSSSSSSSSSSSSSSSSSSSSSSSSSSSSSSSSSSTTDEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 741284 - protein, 761 aa, Homo sapiens; identical to SEQ ID NO: 741277

SEQ ID NO: 741285 - protein, 1321 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPPSSSSSSSSSSSSSSSSSSSSSSSSSSSSSSSSSSSSSSSSSSSSSSSSSSTTDEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRAVLIPSPSLGVRCSPPRAVTNRAAVSHCVQVSSWVYFTNGLDVSG

SEQ ID NO: 741286 - protein, 1080 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPHASSLTAAKRSKAKAKGKEVKKENRGKGGAVSKLMESMAAEEDFEPNQDSSFSEDEHLPRGGAVERP

SEQ ID NO: 741287 - protein, 1069 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPHASSLTAAKRSKAKAKGKEVKKEVRLTVPWLGAVGGSAMLLWSGQGAPPAPLYSPS

SEQ ID NO: 741288 - protein, 630 aa, Homo sapiens
KEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKAHSRSRRRAASRPTRR

SEQ ID NO: 741289 - protein, 631 aa, Homo sapiens
MFGHGLKHLFHSRRRSREREHQTSQDSQQHQQQQGMSDHDSPDEKERSPEMHRVSYAMSLHDLPARPTAFNRVLQQIRSRPSIKRGASLHSSSGGGSSGSSSRRTKSSSLEPQRGSPHLLRKAPQDSSLAAILHQHQCRPRSSSTTDTALLLADGSNVYLLAEEAEGIGDKVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 741290 - protein, 484 aa, Homo sapiens
MNQVVQPLMSRHSACRGSQAHLSWVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 741291 - protein, 366 aa, Homo sapiens
MFGHGLKHLFHSRRRSREREHQTSQDSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 741292 - protein, 499 aa, Homo sapiens
PVLPSVCDPGGLTQSADSWGLRAPGTSSPARLRETVPTQVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 741293 - protein, 709 aa, Homo sapiens
MKRCRSDELQQQQGEEDGAGLEDAASHLPGADLRPGETTGANSAGGPTSDAGAAAAPNPGPRSKPPDLKKIQQLSEGSMFGHGLKHLFHSRRRSREREHQTSQDSQQHQQQQGMSDHDSPDEKERSPEMHRVSYAMSLHDLPARPTAFNRVLQQIRSRPSIKRGASLHSSSGGGSSGSSSRRTKSSSLEPQRGSPHLLRKAPQDSSLAAILHQHQCRPRSSSTTDTALLLADGSNVYLLAEEAEGIGDKVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 741294 - protein, 527 aa, Homo sapiens
PCLSERQFCCEKLPLERSSRPQDSAGQPVTLLTAHCPQLWTSVPLCWPLTEFPAGTVKMKSKEEETAVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 741295 - protein, 484 aa, Homo sapiens; identical to SEQ ID NO: 741290

SEQ ID NO: 741296 - protein, 591 aa, Homo sapiens [sequence omitted]

SEQ ID NO: 741297 - protein, 591 aa, Homo sapiens [sequence omitted]

SEQ ID NO: 741298 - protein, 245 aa, Homo sapiens
RITSSVVLPQDSEREAIEVFMKNSFKDVDQMFQRKLGAQLEARRDDFCKQNSKASSDCCMALLQDIFGPLEEDVKQGTFSKPGGYRLFTQKLQELKNKYYQVPRKGIQAKEVLKKYLESKEDVADALLQTDQSLSEKEKAIEVERIKAESAEAAKKMLEEIQKKNEEMMEQKEKSYQEHVKQLTEKMERDRAQLMAEQEKTLALKLQEQERLLKEGFENESKRLQKDIWDIQMRSKSLEPICNIL

SEQ ID NO: 741299 - protein, 186 aa, Homo sapiens [sequence omitted]

SEQ ID NO: 741300 - protein, 578 aa, Homo sapiens
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIAVNGPRLESLVLTYVNAIGSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLQELKNKYYQVPRKGIQAKEVLKKYLESKEDVADALLQTDQSLSEKEKAIEVERIKAESAEAAKKMLEEIQKKNEEMMEQKEKSYQEHVKQLTEKMERDRAQLMAEQEKTLALKLQVAHRCSRIVREPYSTAIPPRIILPL

SEQ ID NO: 741301 - protein, 563 aa, Homo sapiens
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIAVNGPRLESLVLTYVNAIGSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLQELKNKYYQVPRKGIQAKEVLKKYLESKEDVADALLQTDQSLSEKEKAIEVERIKAESAEAAKKMLEEIQKKNEEMMEQKEKSYQEHVKQLTEKMERDRAQLMAEQEKTLALKLQNRNAFSRRVS

SEQ ID NO: 741302 - protein, 270 aa, Homo sapiens
IQKKNEVMMEQKEKSYQEHVKQLTEKMERDRAQLMAEQEKTLALKLQEQERLLKEGFENESKRLQKDIGDDFCKQNSKASSDCCMALLQDIFGPLEEDVKQGTFSKPGGYRLFTQKLQELKNKYYQVPRKGIQAKEVLKKYLESKEDVADALLQTDQSLSEKEKAIEVERIKAESAEAAKKMLEEIQKKNEEMMEQKEKSYQEHVKQLTEKMERDRAQLMAEQEKTLALKLQEQERLLKEGFENESKRLQKDIWDIQMRSKSLEPICNIL

SEQ ID NO: 741303 - protein, 434 aa, Homo sapiens
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIAVNGPRLESLVLTYVNAIGSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGFRLHGGSSRFD

SEQ ID NO: 741304 - protein, 205 aa, Homo sapiens
MSVDPMTYEAQFFGFTPQTCMLRIYIAFQDYLFEVMQAVEQVILKKLDGIPDCDISPVQIRKCTEKFFCFMKGDFDNLFSKMEQLFLQLILRIPSNILLPEDKCKETPYSEEDFQHLQKEIEQLQEKYKTELCTKQALLAELEEQKIVQAKLKQTLTFFDELHNVGRDHGTSDFRESLVSLVQNSRKLQNIRDNVEKESKRLKIS

SEQ ID NO: 741305 - protein, 373 aa, Homo sapiens
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQVMLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNAGITGVSHHAQPNSLFLIVALYHILQMCESAMD

SEQ ID NO: 741306 - protein, 358 aa, Homo sapiens
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQVMLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNILVADQTSCISVYPLNEF

SEQ ID NO: 741307 - protein, 374 aa, Homo sapiens
MRLQLFPPLHRVSGTIMAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQVMLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNILVADQTSCISVYPLNEF

SEQ ID NO: 741308 - protein, 358 aa, Homo sapiens; identical to SEQ ID NO: 741306

SEQ ID NO: 741309 - protein, 222 aa, Homo sapiens
DARRDWAPAGEVITRRRGGEREAQVMLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNILVADQTSCISVYPLNEF

SEQ ID NO: 741310 - protein, 373 aa, Homo sapiens; identical to SEQ ID NO: 741305

SEQ ID NO: 741311 - protein, 358 aa, Homo sapiens; identical to SEQ ID NO: 741306

SEQ ID NO: 741312 - protein, 358 aa, Homo sapiens; identical to SEQ ID NO: 741306

SEQ ID NO: 741313 - protein, 176 aa, Homo sapiens
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQVMLLHRVLGEFLSGIC

SEQ ID NO: 741314 - protein, 132 aa, Homo sapiens
SVDGKQLEGFEEGWCDLTRILESSRWLKCGGKKQGAEVEVRGSQLGGYRSSPDQTGGWLGPQRSWWGRLESDQVRANRTFFFRLGLACCPGCSALVQSWLTAALTSWIKVSSHLSAAREAGAGELLEPGRQK

SEQ ID NO: 741315 - protein, 198 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGRHCTPPTQQTHHLLPLHPAHLPPCSQRLLPQRPPLHCHWLGSCGPLSEPPDAQATAATRGASDQS

SEQ ID NO: 741316 - protein, 184 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGRHCTPPTQQTHHLLPLHPAHLPPLAPNGLPFPQTGLSNWQLGHLGLGGSMG

SEQ ID NO: 741317 - protein, 108 aa, Homo sapiens
QASNDVRGHGPAHWPSSWGAPGTLGYENEPWLPPVSGRLLPARLPRLMSTSLCPLPVFWAGATFVQLRGQERPQSCPLAAERPRALTPGLRRTEPPPELGWRLDLGWE

SEQ ID NO: 741318 - protein, 198 aa, Homo sapiens; identical to SEQ ID NO: 741315

SEQ ID NO: 741319 - protein, 198 aa, Homo sapiens; identical to SEQ ID NO: 741315

SEQ ID NO: 741320 - protein, 198 aa, Homo sapiens; identical to SEQ ID NO: 741315

SEQ ID NO: 741321 - protein, 198 aa, Homo sapiens; identical to SEQ ID NO: 741315

SEQ ID NO: 741322 - protein, 123 aa, Homo sapiens
MVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 741323 - protein, 198 aa, Homo sapiens; identical to SEQ ID NO: 741315

SEQ ID NO: 741324 - protein, 184 aa, Homo sapiens
ELGSLALLGALLFWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 741325 - protein, 178 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGRHCTPPVSTSQVGLQAPTMPRIQNFVYHSPQQPRCENRIPLVPEL

SEQ ID NO: 741326 - protein, 123 aa, Homo sapiens [sequence omitted]

SEQ ID NO: 741327 - protein, 89 aa, Homo sapiens
LILDVPRSSCYTRQLNDRWAKGELPLLGARKVTNLKMLLPAQILNASSQQLRGLPFAISTTASCQHRYRSQRCEQTMESTLSLAVVYIF

SEQ ID NO: 741328 - protein, 115 aa, Homo sapiens
ALPVQSSVARAAGSCSHQLEDVEREHQKRTARSLARSLRDAVGAPSRASTLWERICRGEAREPNVSVPPVACPALVSALSGPSTLKASSRDQGKEYCVRLADFLLSVWTGLIFAC

SEQ ID NO: 741329 - protein, 51 aa, Homo sapiens
MELCWDKCVEKPGNRLDSRTENCLSSCVDRFIDTTLAITSRFAQIVQKGGQ

SEQ ID NO: 741330 - protein, 94 aa, Homo sapiens
SCRKVASLRRTMAELGEADEAELQRLVAAEQQKAQFTAQVHHFMELCWDKCVEKPGNRLDSRTENCLSSCVDRFIDTTLAITSRFAQIVQKGGQ

SEQ ID NO: 741331 - protein, 94 aa, Homo sapiens; identical to SEQ ID NO: 741330

SEQ ID NO: 741332 - protein, 51 aa, Homo sapiens; identical to SEQ ID NO: 741329

SEQ ID NO: 741333 - protein, 211 aa, Homo sapiens
MEEPPVREEEEEEGEEDEERDEVGPEGALGKSPFQLTAEDVYDISYLLGRELMALGSDPRVTQLQFKVVRVLEMLEALVNEGSLALEELKMERDHLRKEVEGLRRQSPPASGEVNLGPNKMVVDLTDPNRPRFTLQELRDVLQERNKLKSQLLVVQEELQCYKSGLIPPREGPGGRREKDAVVTSAKNAGRNKEEKTIIKKLFFFRSGKQT

SEQ ID NO: 741334 - protein, 164 aa, Homo sapiens
MEEPPVREEEEEEGEEDEERDEVGPEGALGKSPFQLTAEDVYDISYLLGRELMALGSDPRVTQLQFKVVRVLEMLEALVNEGSLALEELKMERDHLRKEVEGLRRQSPPASGEVNLGPNKMVVDLTDPNRPRFTLQELRDVLQERNKLKSQLLVVQEELQCYKS

SEQ ID NO: 741335 - protein, 240 aa, Homo sapiens
RLHESWLRRLGREGSVDGRMVRGSSVAEDKRKKEVKEMRIDRASRDRRSGGRGERVGKESSLRVDRAEDVYDISYLLGRELMALGSDPRVTQLQFKVVRVLEMLEALVNEGSLALEELKMERDHLRKEVEGLRRQSPPASGEVNLGPNKMVVDLTDPNRPRFTLQELRDVLQERNKLKSQLLVVQEELQCYKSGLIPPREGPGGRREKDAVVTSAKNAGRNKEEKTIIKKLFFFRSGKQT

SEQ ID NO: 741336 - protein, 118 aa, Homo sapiens
CGCWGGYRKPFPWLGRKQSQDMTAGCMAPDPGGVFYYRLQLDSQHSHLPGVTQASGTRTGWHPESLQACPTDSNQSQGRWLTPALLGQPAFWAFQKFLHAFCCLLPCPAAPLPYLLMN

SEQ ID NO: 741337 - protein, 594 aa, Homo sapiens
MGKKSRVKTQKSGTGATATVSPKEILNLTSELLQKCSSPAPGPGKEWEEYVQIRTLVEKIRKKQKGLSVTFDGKREDYFPDLMKWASENGASVEGFEMVNFKEEGFGLRATRDIKAEELFLWVPRKLLMTVESAKNSVLGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLITTGYNLEDDRCECVALQDFRAGEQIYIFYGTRSNAEFVIHSGFFFDNNSHDRVKIKLGVSKSDRLYAMKAEVLARAGIPTSSVFALHFTEPPISAQLLAFLRVFCMTEEELKEHLLGDSAIDRIFTLGNSEFPVSWDNEVKLWTFLEDRASLLLKTYKTTIEEDKSVLKNHDLSVRAKMAIKLRLGEKEILEKAVKSAAVNREYYRQQMEEKAPLPKYEESNLGLLESSVGDSRLPLVLRNLEEEAGVQDALNIREAISKAKATENGLVNGENSIPNGTRSENESLNQESKRAVEDAKGSSSDSTAGVKE

SEQ ID NO: 741338 - protein, 594 aa, Homo sapiens; identical to SEQ ID NO: 741337

SEQ ID NO: 741339 - protein, 498 aa, Homo sapiens
MVNVHREGLRLDEPNGYTKVQRGMMGLRSLLCELSNVLKVHVWGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLITTGYNLEDDRCECVALQDFRAGEQIYIFYGTRSNAEFVIHSGFFFDNNSHDRVKIKLGVSKSDRLYAMKAEVLARAGIPTSSVFALHFTEPPISAQLLAFLRVFCMTEEELKEHLLGDSAIDRIFTLGNSEFPVSWDNEVKLWTFLEDRASLLLKTYKTTIEEDKSVLKNHDLSVRAKMAIKLRLGEKEILEKAVKSAAVNREYYRQQMEEKAPLPKYEESNLGLLESSVGDSRLPLVLRNLEEEAGVQDALNIREAISKAKATENGLVNGENSIPNGTRSENESLNQESKRAVEDAKGSSSDSTAGVKE

SEQ ID NO: 741340 - protein, 382 aa, Homo sapiens
YILYIDNYKSRSPHPPSSHLLPLTDSFTYEDNRWAVSSVMTRQNQIPTEDGSRVTLALIPLWDMCNHTNGLITTGYNLEDDRCECVALQDFRAGEQIYIFYGTRSNAEFVIHSGFFFDNNSHDRVKIKLGVSKSDRLYAMKAEVLARAGIPTSSVFALHFTEPPISAQLLAFLRVFCMTEEELKEHLLGDSAIDRIFTLGNSEFPVSWDNEVKLWTFLEDRASLLLKTYKTTIEEDKSVLKNHDLSVRAKMAIKLRLGEKEILEKAVKSAAVNREYYRQQMEEKAPLPKYEESNLGLLESSVGDSRLPLVLRNLEEEAGVQDALNIREAISKAKATENGLVNGENSIPNGTRSENESLNQESKRAVEDAKGSSSDSTAGVKE

SEQ ID NO: 741341 - protein, 594 aa, Homo sapiens; identical to SEQ ID NO: 741337

SEQ ID NO: 741342 - protein, 162 aa, Homo sapiens
RSTEHRAIYLIRENAVWFKKNHQDLSVRAKMAIKLRLGEKEILEKAVKSAAVNREYYRQQMEEKAPLPKYEESNLGLLESSVGDSRLPLVLRNLEEEAGVQDALNIREAISKAKATENGLVNGENSIPNGTRSENESLNQESKRAVEDAKGSSSDSTAGVKE

SEQ ID NO: 741343 - protein, 594 aa, Homo sapiens; identical to SEQ ID NO: 741337

SEQ ID NO: 741344 - protein, 594 aa, Homo sapiens; identical to SEQ ID NO: 741337

SEQ ID NO: 741345 - protein, 110 aa, Homo sapiens
MGKKSRVKTQKSGTGATATVSPKEILNLTSELLQKCSSPAPGPGKEWEEYVQIRTLVEKIRKKQKGLSVTFDGKREDYFPDLMKCLNQESKRAVEDAKGSSSDSTAGVKE

SEQ ID NO: 741346 - protein, 594 aa, Homo sapiens; identical to SEQ ID NO: 741337

SEQ ID NO: 741347 - protein, 594 aa, Homo sapiens; identical to SEQ ID NO: 741337

SEQ ID NO: 741348 - protein, 594 aa, Homo sapiens; identical to SEQ ID NO: 741337

SEQ ID NO: 741349 - protein, 296 aa, Homo sapiens
MGKKSRVKTQKSGTGATATVSPKEILNLTSELLQKCSSPAPGPGKEWEEYVQIRTLVEKIRKKQKGLSVTFDGKREDYFPDLMKWASENGASVEGFEMVNFKEEGFGLRATRDIKAEELFLWVPRKLLMTVESAKNSVLGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLTPEDSFALAVASA

SEQ ID NO: 741350 - protein, 296 aa, Homo sapiens; identical to SEQ ID NO: 741349

SEQ ID NO: 741351 - protein, 284 aa, Homo sapiens
MGKKSRVKTQKSGTGATATVSPKEILNLTSELLQKCSSPAPGPGKEWEEYVQIRTLVEKIRKKQKGLSVTFDGKREDYFPDLMKWASENGASVEGFEMVNFKEEGFGLRATRDIKAEELFLWVPRKLLMTVESAKNSVLGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLV

SEQ ID NO: 741352 - protein, 73 aa, Homo sapiens
AICFRLYFSGSPMTLGCPGQALEVPQEDQLGLPPLECTAPWPLSTPPPPFPAFFLTNTKGGRNQKTGDPAALG

SEQ ID NO: 741353 - protein, 445 aa, Homo sapiens
METRTEDGGLTRRPTLASSWDVAGGALTHSLLLTRAGLGPGDFDWEELLAPPAPGQDLVILKRNHNNKDENPCFLYLRCGPDGGEEIASIGILSSARNMEVYLGEEYCGTSRGKNVCTVLDDSEHEKIILYKKNLKLESSTHACKIKLLSFGERQCVFISKVVVHMRSVFANSSTSSPALGSRIDLDKVQTIMESMGSKLSPGAQQLMDMVRCQQRNCIPIGEQLQSVLGNSGYKHMIGLQSSSTLGTLNKSSSTPFPFRTGLTSGNVTENLQTYIDKSTQLPGGENSTKLDECKVMPQNHSFLENDLKNAMASFLPKKVSDNSNIPNSELLPFLQNLCSQVNHLHVGNKTECQENITKHGERILGVGMEEQSICSYLEKILSKNMELMEKKLMDYIDQRIHELQEHIDDKIALLLDLLQNPNSPPTGIPLRHYDSGERLSNGER

SEQ ID NO: 741354 - protein, 107 aa, Homo sapiens
DGVLSPRLECSCAISAHCSLCLPGSSNPPRMEEQSICSYLEKILSKNMELMEKKLMDYIDQRIHELQEHIDDKIALLLDLLQNPNSPPTGIPLRHYDSGERLSNGER

SEQ ID NO: 741355 - protein, 445 aa, Homo sapiens; identical to SEQ ID NO: 741353

SEQ ID NO: 741356 - protein, 147 aa, Homo sapiens
GRRFTYPSLLVSHRRMHSGERPFPCPECGMRFKRKFAVEAHQWIHRSCSGGRRGRRPGIRAVLGPPSEVTGTRLCSSGTTQTSSRSAAERHRRLELSLTLARRTDGSLRWATESGTPELKFMPWAFLKDPSSFQLVKRKVPVKIRID

SEQ ID NO: 741357 - protein, 108 aa, Homo sapiens
MLILIGSLDSDPGTPPSAPQLDATSDGHSQPLPAAKRWPSGTLYGLRHLRAVLGPAGTPDMNRLKNWSEVHTSPSFSLRKKGKPWDQELSRLLPRAAARTLTLSPITP

SEQ ID NO: 741358 - protein, 59 aa, Homo sapiens
AADYYYYCSEFKLLTMYGDMNEKGHIFKNTWQMSVSLKVLTGFYYSCYLFPLPIFCALK

SEQ ID NO: 741359 - protein, 1237 aa, Homo sapiens
MAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFSAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDEALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 741360 - protein, 148 aa, Homo sapiens
MAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYEVCIWSSAHCLLLHGKDVCYNNFWNKYS

SEQ ID NO: 741361 - protein, 1016 aa, Homo sapiens
MVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDEALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 741362 - protein, 200 aa, Homo sapiens
MGRLHCTEDPVPEAVGGDMQQLNQLGAQQFSALTEVLFHFLTEPKEVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIELTLPQFYSFLHEMERVRTSMECFC

SEQ ID NO: 741363 - protein, 279 aa, Homo sapiens
SGWYTPGVLGSGGLCVLLPARAPRLRTAQGGRGRSALRRPWRKCGCGCAERPAAVAAAAEEEAEQGGGGGGTCGAGARAMGRLHCTEDPVPEAVGGDMQQLNQLGAQQFSALTEVLFHFLTEPKEVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIELTLPQFYSFLHEMERVRTSMECFC

SEQ ID NO: 741364 - protein, 200 aa, Homo sapiens
MGRLHCTEDPVPEAVGGDMQQLNQLGAQQFSALTEVLFHFLTEPKEVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIGESEFLEPLHLFCVLLQSGAWLTLT

SEQ ID NO: 741365 - protein, 210 aa, Homo sapiens
MGRLHCTEDPVPEAVGGDMQQLNQLGAQQFSALTEVLFHFLTEPKEARVFTVLSLQVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIELTLPQFYSFLHEMERVRTSMECFC

SEQ ID NO: 741366 - protein, 140 aa, Homo sapiens
SRINLLLRFLQTDGLGLLFIIILATPLMSLPMLSLFSWSLYISSLLIFNSHLGITFFSNFLRRQSMACGLHWLFSVCFSSLVLRLFLLVLCPWRLTCLYSITWGTHLPVGTGQCEAMVGRSEGSGKRLEGITEGLSEIYI

SEQ ID NO: 741367 - protein, 98 aa, Homo sapiens
KGCHTDPLPLLAEGSHLTQKGRGSTELLTLKPYADSQAKRAPKHFLWDFRGHWHPSPDVAAGPVQSSLLLVPEGICPSCRTHSPVCSLQQGVEHSRFE

SEQ ID NO: 741368 - protein, 325 aa, Homo sapiens
MAVGNNTQRSYSIIPCFIFVELVIMAGTVLLAYYFECTDTFQVHIQGFFCQDGDLMKPYPGTEEESFITPLVLYCVLAATPTAIIFIGEISMYFIKSTRESLIAQEKTILTGECCYLNPLLRRIIRFTGVFAFGLFATDIFVNAGQVVTGHLTPYFLTVCKPNYTSADCQAHHQFINNGNICTGDLEVIEKARRSFPSKHAALSIYSALYATMYITSTIKTKSSRLAKPVLCLGTLCTAFLTGLNRVSEYRNHCSDVIAGFILGTAVALFLGMCVVHNFKGTQGSPSKPKPEDPRGVPLMAFPRIESPLETLSAQNHSASMTEVT

SEQ ID NO: 741369 - protein, 325 aa, Homo sapiens; identical to SEQ ID NO: 741368

SEQ ID NO: 741370 - protein, 309 aa, Homo sapiens [sequence omitted]

SEQ ID NO: 741371 - protein, 146 aa, Homo sapiens
GIRNLFRFLCFFCDPYFFRLPAQPVRRLAAVPAIPRESVAPSAKTWTLSQKPWAPAPCLLQPPKSGKPQALRVLVTASLVVPGLLLHLFHGPAISLVQPRTIGRKRWRAEGDACWAFPLVTECFLRRVRCYQWRPGRLSLSSFWSP

SEQ ID NO: 741372 - protein, 257 aa, Homo sapiens
MTNMNLVLTKQNLLHMELLLLETFQWNLCLPTAAHFIEYYLSEAVHETDLHDGWPMICLEKTKLYMAKYADYFLEVSLQAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 741373 - protein, 269 aa, Homo sapiens
MTNMNLVLTKQNLLHMELLLLETFQWNLCLPTAAHFIEYYLSEAVHETDLHDGWPMICLEKTKLYMAKYADYFLEVSLQDYAFLNYAPSLVAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 741374 - protein, 257 aa, Homo sapiens; identical to SEQ ID NO: 741372

SEQ ID NO: 741375 - protein, 257 aa, Homo sapiens; identical to SEQ ID NO: 741372

SEQ ID NO: 741376 - protein, 70 aa, Homo sapiens
HPTSRGVHRQRRGFAKTGVLLEASRFEKESVTTKQTTLYLTVEQFVPTFARRVYVSVEPCPWLRGHGPRR

SEQ ID NO: 741377 - protein, 130 aa, Homo sapiens
ATRRMARPGAAAAPAPNAAATSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDG

SEQ ID NO: 741378 - protein, 119 aa, Homo sapiens
MAKKGQAWMGSHTHTRREEHAWMGSLTLGMWCFHPKSGQGVCLWHQCPQAWLRAPARDWPAFSIIFYGVLVTVNQLSQASGPGPRPWRFPGVNVNALHGSRESLACLVLSAAAPAADWA

SEQ ID NO: 741379 - protein, 101 aa, Homo sapiens
DFPKYWDYRREPPHRALRPLFHPYSSLCLCMCVPHPFGNFYFLFQEWVKVSDFFFPYTLSVQSGPTWRRAAAFPPFFCGRLQTLAHGRVRAVPRVGAIKLS

SEQ ID NO: 741380 - protein, 162 aa, Homo sapiens
VEAGVFSDSELYRPRVTMKFNPFVTSDRSKNRKRHFNAPSHVRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQVGKEKGKYKEELIEKMQE

SEQ ID NO: 741381 - protein, 160 aa, Homo sapiens
GRVGRSEAASSRRVTMKFNPFVTSDRSKNRKRHFNAPSHVRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQVGKEKGKYKEELIEKMQE

SEQ ID NO: 741382 - protein, 160 aa, Homo sapiens; identical to SEQ ID NO: 741381

SEQ ID NO: 741383 - protein, 145 aa, Homo sapiens
MKFNPFVTSDRSKNRKRHFNAPSHVRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQVGKEKGKYKEELIEKMQE

SEQ ID NO: 741384 - protein, 145 aa, Homo sapiens; identical to SEQ ID NO: 741383

SEQ ID NO: 741385 - protein, 103 aa, Homo sapiens
GLAPAGGPSLSLQLPLPPAAAPRQSCDPTAGGAGRGKIWPPWSFCVGSSERERRGGTPEKSLGGCVLLLPKLGVRTNPAAPTGLTGEEEGLGTVGSPSQPGGA

SEQ ID NO: 741386 - protein, 322 aa, Homo sapiens
TVAFSSHRRKISFCLRRETKPHTKERGMMAKKPPKPAPRRIFQERLKITALPLYFEGFLLIKRSGYREYEHYWTELRGTTLFFYTDKKSIIYVDKLDIVDLTCLTEQNSTEKNCAKFTLVLPKEEVQLKTENTESGEEWRGFILTVTELSVPQNVSLLPGQVIKLHEVLEREKKRRIETEQSTSVEKEKEPTEDYVDVLNPMPACFYTVSRKEATEMLQKNPSLGNMILRPGSDSRNYSITIRQEIDIPRIKHYKVMSVGQNYTIELEKPVTLPNLFSVIDYFVKETRGNLRPFICSTDENTGQEPSMEGRSEKLKKNPHIA

SEQ ID NO: 741387 - protein, 322 aa, Homo sapiens; identical to SEQ ID NO: 741386

SEQ ID NO: 741388 - protein, 322 aa, Homo sapiens; identical to SEQ ID NO: 741386

SEQ ID NO: 741389 - protein, 322 aa, Homo sapiens; identical to SEQ ID NO: 741386

SEQ ID NO: 741390 - protein, 52 aa, Homo sapiens
MLLSSLMCLMPSLEIYLLDHHFHIYLVTRSPSYGILKFMIHNPCQKSCSELW

SEQ ID NO: 741391 - protein, 123 aa, Homo sapiens
FLVLCIGAAFLGVGTSVSPCCRGRSACLLHQKPPLLMLSAPLGEQLPTQLLLPPRSSGSKFHRYQRPGPRVGVHLHKGSSEIREAGGPQLWPQCPHPVDLDVLRTTQHCLQSEGPTSVHLSSV

SEQ ID NO: 741392 - protein, 123 aa, Homo sapiens; identical to SEQ ID NO: 741391

SEQ ID NO: 741393 - protein, 123 aa, Homo sapiens; identical to SEQ ID NO: 741391

SEQ ID NO: 741394 - protein, 109 aa, Homo sapiens
GVWMMSSSLPHVTSNHVSYNGLYGVAVFSQKDGSSELPRGHRAQENFSEDGDAILWETELEKEDDPLRRPITIALVESNSINHNGGEYTPSAPAQEPSMAPHCLFFSPI

SEQ ID NO: 741395 - protein, 392 aa, Homo sapiens
IQLPETLLQPSQGTAPLCLLLLQGSTMQPLWLCWALWVLPLASPGAALTGEQLLGSLLRQLQLKEVPTLDRADMEELVIPTHVRAQYVALLQRSHGDRSRGKRFSQSFREVAGRFLALEASTHLLVFGMEQRLPPNSELVQAVLRLFQEPVPKAALHRHGRLSPRSARARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLGDYGAQGDCDPEAPMTEGTRCCRQEMYIDLQGMKWAENWVLEPPGFLAYECVGTCRQPPEALAFKWPFLGPRQCIASETDSLPMIVSIKEGGRTRPQVVSLPNMRVQKCSCASDGALVPRRLQP

SEQ ID NO: 741396 - protein, 392 aa, Homo sapiens; identical to SEQ ID NO: 741395

SEQ ID NO: 741397 - protein, 705 aa, Homo sapiens
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 741398 - protein, 689 aa, Homo sapiens
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTESH

SEQ ID NO: 741399 - protein, 720 aa, Homo sapiens
HEPTLGYGRGWWESAEDDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 741400 - protein, 519 aa, Homo sapiens
ASTRPGGDHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 741401 - protein, 720 aa, Homo sapiens
HEPTLGYGRGWWESAEDDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQVSICMQSAYNEGTLMKFQKITGDARIPLPLDSFPVPVSTPEGLGTSSNNLGVPATEQRQESFEGFIARMCSPSPDATSGTGSQRKEEELSRNSRSSSEKKTKTESH

SEQ ID NO: 741402 - protein, 283 aa, Homo sapiens
MSFSIWYSVYIIIQSCPLFLSQPGFPVTVTVESPSSSEVEEVDDSSESVHEVPEKTSIEQEALQLEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 741403 - protein, 157 aa, Homo sapiens
MAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 741404 - protein, 119 aa, Homo sapiens [sequence omitted]

SEQ ID NO: 741405 - protein, 843 aa, Homo sapiens
MWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGICTNFQKNNPVHTLTEVELLAFTSCLLSQPKFWAIQTSALILRTKLEKGSTRRVERAMRQTQALADQFEDKTTSVLERLKIFYCCQVPPHWAIQRQLASLLFELGCTSSALQIFEKLEMWEDVVICYERAGQHGKAEEILRQELEKKETPSLYCLLGDVLGDHSCYDKAWELSRYRSARAQRSKALLHLRNKEFQECVECFERSVKINPMQLGVWFSLGCAYLALEDYQGSAKAFQRCVTLEPDNAEAWNNLSTSYIRLKQKVKAFRTLQEALKCNYEHWQIWENYILTSTDVGEFSEAIKAYHRLLDLRDKYKDVQVLKILVRAVIDGMTDRSGDVATGLKGKLQELFGRVTSRVTNDGEIWRLYAHVYGNGQSEKPDENEKAFQCLSKAYKCDTQSNCWEKDITSFKEVVQRALGLAHVAIKCSKNKSSSQEAVQMLSSVRLNLRGLLSKAKQLFTDVATGEMSRELADDITAMDTLVTELQDLSNQFRNQY

SEQ ID NO: 741406 - protein, 668 aa, Homo sapiens
MWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGICTNFQKNNPVHTLTEVELLAFTSCLLSQPKFWAIQTSALILRTKLEKGSTRRVERAMRQTQALADQFEDKTTSVLERLKIFYCCQVPPHWAIQRQLASLLFELGCTSSALQIFEKLEMWEDVVICYERAGQHGKAEEILRQELEKKETPSLYCLLGDVLGDHSCYDKAWELSRYRSARAQRSKALLHLRNKEFQECVECFERSVKINPMQLGVWFSLGCAYLALEDYQGSAKAFQRCVTLEPDNAEAWNNLSTSYIRLKQKVKAFRTLQEALKCNYEHWQIWENYILTSTDVGEFSEAIKAYHRLLDLRDKYKDVQWP

SEQ ID NO: 741407 - protein, 528 aa, Homo sapiens
MMHTNTEWHRVPRCKLTWMSHLCTEYSSYNTWSLLYIQKNRRVQRLTWKCRYWRSNSHVRFHITRCLGIQTSALILRTKLEKGSTRRVERAMRQTQALADQFEDKTTSVLERLKIFYCCQVPPHWAIQRQLASLLFELGCTSSALQIFEKLEMWEDVVICYERAGQHGKAEEILRQELEKKETPSLYCLLGDVLGDHSCYDKAWELSRYRSARAQRSKALLHLRNKEFQECVECFERSVKINPMQLGVWFSLGCAYLALEDYQGSAKAFQRCVTLEPDNAEAWNNLSTSYIRLKQKVKAFRTLQEALKCNYEHWQIWENYILTSTDVGEFSEAIKAYHRLLDLRDKYKDVQVLKILVRAVIDGMTDRSGDVATGLKGKLQELFGRVTSRVTNDGEIWRLYAHVYGNGQSEKPDENEKAFQCLSKAYKCDTQSNCWEKDITSFKEVVQRALGLAHVAIKCSKNKSSSQEAVQMLSSVRLNLRGLLSKAKQLFTDVATGEMSRELADDITAMDTLVTELQDLSNQFRNQY

SEQ ID NO: 741408 - protein, 429 aa, Homo sapiens
MWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGICTNFQKNNPVHTLTEVELLAFTSCLLSQPKFWAIQTSALILRTKLEKGSTRRVERAMRQTQVAHDVHLSCHWGCYLIIQ

SEQ ID NO: 741409 - protein, 139 aa, Homo sapiens
AARGVVFSRLCLFGLGRLSRFSKGISALCDSRTRCLCIFHCLVYRNFVVSFENANAEAWNNLSTSYIRLKQKVKAFRTLQEALKCNYEHWQIWENYILTSTDVGEFSEAIKAYHRLLDLRDKYKDVQVGYSYSVISVCV

SEQ ID NO: 741410 - protein, 843 aa, Homo sapiens; identical to SEQ ID NO: 741405

SEQ ID NO: 741411 - protein, 495 aa, Homo sapiens
WAAAAPGTCLNVALRSLPPGRRGAPLRGAARAACAERPRPSVLSRPGRLPGANRRRTRVALAAALADQFEDKTTSVLERLKIFYCCQVPPHWAIQRQLASLLFELGCTSSALQIFEKLEMWEDVVICYERAGQHGKAEEILRQELEKKETPSLYCLLGDVLGDHSCYDKAWELSRYRSARAQRSKALLHLRNKEFQECVECFERSVKINPMQLGVWFSLGCAYLALEDYQGSAKAFQRCVTLEPDNAEAWNNLSTSYIRLKQKVKAFRTLQEALKCNYEHWQIWENYILTSTDVGEFSEAIKAYHRLLDLRDKYKDVQVLKILVRAVIDGMTDRSGDVATGLKGKLQELFGRVTSRVTNDGEIWRLYAHVYGNGQSEKPDENEKAFQCLSKAYKCDTQSNCWEKDITSFKEVVQRALGLAHVAIKCSKNKSSSQEAVQMLSSVRLNLRGLLSKAKQLFTDVATGEMSRELADDITAMDTLVTELQDLSNQFRNQY

SEQ ID NO: 741412 - protein, 304 aa, Homo sapiens
AARGVVFSRLCLFGLGRLSRFSKGISALCDSRTRCLCIFHCLVYRNFVVSFENANAEAWNNLSTSYIRLKQKVKAFRTLQEALKCNYEHWQIWENYILTSTDVGEFSEAIKAYHRLLDLRDKYKDVQVLKILVRAVIDGMTDRSGDVATGLKGKLQELFGRVTSRVTNDGEIWRLYAHVYGNGQSEKPDENEKAFQCLSKAYKCDTQSNCWEKDITSFKEVVQRALGLAHVAIKCSKNKSSSQEAVQMLSSVRLNLRGLLSKAKQLFTDVATGEMSRELADDITAMDTLVTELQDLSNQFRNQY

SEQ ID NO: 741413 - protein, 342 aa, Homo sapiens
AARGVVFSRLCLFGLGRLSRFSKGISALCDSRTRCLCIFHCLVYRNFVVSFENANAEAWNNLSTSYIRLKQKVKAFRTLQEALKCNYEHWQIWENYILTSTELYLGGLIANKGGLTGRHMATTPPPPPARRGRAGGGGWGGGGGGGVLRAYHRLLDLRDKYKDVQVLKILVRAVIDGMTDRSGDVATGLKGKLQELFGRVTSRVTNDGEIWRLYAHVYGNGQSEKPDENEKAFQCLSKAYKCDTQSNCWEKDITSFKEVVQRALGLAHVAIKCSKNKSSSQEAVQMLSSVRLNLRGLLSKAKQLFTDVATGEMSRELADDITAMDTLVTELQDLSNQFRNQY

SEQ ID NO: 741414 - protein, 186 aa, Homo sapiens
ARSRHGSGGEGPSELFCGIREQQLRLLGREDNIEPERRVAEPRIRRSRRAAVGTRRRSGSRDLDELFRSVTRPAFLYNPLNKQIDWERHVVKAPEEPPKEFKIWKSNYVPPPETYTTEKKPPPPELDMAIKWSNIYEDNGDDAPQNAKKARLLPEGEETLESDDEKDEHTSKKRKVEPGEPAKKKK

SEQ ID NO: 741415 - protein, 574 aa, Homo sapiens
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAMQASPETKQTIWQLATEPTGPLVQRITKNILVVKCKASQKHSLGYLHTSFVQKVSGKSLPERRFFCSCQTLKSHKSNASKDETAQRCIHFFACICAFASDETLAQEFSDFLNFDSSGLKEIIVPQLGCHSESTVSACESTASKSKKRRKDEVSGAQMNSSLLPQDAVSSNLRKSGLKKPVVASSLKRQACGQLLDEAQVTLSFQDWLASVTERIHQTMHYQFDGKPEPLVFHIPQSFFDALQQRISIGSAKKRLPNSTTAFVRKDALPLGTFSKYTWHITNILQVKQILDTPEMPLEITRSFIQNRDGTYELFKCPKVEVESIAETYGRIEKQPVLRPLELKTFLKVGNTSPDQKEPTPFIIEWIPDILPQSKIGELRIKFEYGHHRNGHVAEYQDQRPPLDQPLELAPLTTITFP

SEQ ID NO: 741416 - protein, 574 aa, Homo sapiens; identical to SEQ ID NO: 741415

SEQ ID NO: 741417 - protein, 574 aa, Homo sapiens; identical to SEQ ID NO: 741415

SEQ ID NO: 741418 - protein, 574 aa, Homo sapiens; identical to SEQ ID NO: 741415

SEQ ID NO: 741419 - protein, 574 aa, Homo sapiens; identical to SEQ ID NO: 741415

SEQ ID NO: 741420 - protein, 574 aa, Homo sapiens; identical to SEQ ID NO: 741415

SEQ ID NO: 741421 - protein, 485 aa, Homo sapiens [sequence omitted]

SEQ ID NO: 741422 - protein, 115 aa, Homo sapiens [sequence omitted]

SEQ ID NO: 741423 - protein, 480 aa, Homo sapiens
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 741424 - protein, 480 aa, Homo sapiens; identical to SEQ ID NO: 741423

SEQ ID NO: 741425 - protein, 470 aa, Homo sapiens
MKRSVAVWLLVGLSLGVPQFGKGDICDPNPCENGGICLPGLADGSFSCECPDGFTDPNCSSVVEVGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 741426 - protein, 257 aa, Homo sapiens [sequence omitted]

SEQ ID NO: 741427 - protein, 257 aa, Homo sapiens [sequence omitted]

SEQ ID NO: 741428 - protein, 438 aa, Homo sapiens
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSIRILPWSWYGRITLRSELLGCTEEE

SEQ ID NO: 741429 - protein, 65 aa, Homo sapiens
VEHAPYPTSAKRHQPLVFQGNFDNDTHRKNVIDPPIYARHIRILPWSWYGRITLRSELLGCTEEE

SEQ ID NO: 741430 - protein, 159 aa, Homo sapiens
YSYEGQCRLLGCKHQAPERQLQPSTLSLRQAAHLPSPGGCSCSQRDGQPGLQRAGIVIAVTGENRALSSGNRFLSSSWSWELGWNWVRTSFPATQAQRESQKYRGHKLSPFPSDSQIRRREAQSQLGKPWGLAVESNFNEMRRMPKVQSQRASLDSQAF

SEQ ID NO: 741431 - protein, 237 aa, Homo sapiens
QAGTVREALIRSEEAPARAQAAGMAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYGETSFPCFSP

SEQ ID NO: 741432 - protein, 249 aa, Homo sapiens
GAGGSVEPPSARPAPQPAGTAARSEEAPARAQAAGMAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYGETSFPCFSP

SEQ ID NO: 741433 - protein, 198 aa, Homo sapiens [sequence omitted]

SEQ ID NO: 741434 - protein, 494 aa, Homo sapiens
LVLASRFWDRSEEAPARAQAAGMAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYEALFGQPPFASRSFSELEEKIRSNRVIELPLRPLLSRDCRDLLQRLLERDPSRRISFQDFFAHPWVDLEHMPSGESLGRATALVVQAVKKDQEGDSAAALSLYCKALDFFVPALHYEVDAQRKEAIKAKVGQYVSRAEELKAIVSSSNQALLRQGTSARDLLREMARDKPRLLAALEVASAAMAKEEAAGGEQDALDLYQHSLGELLLLLAAEPPGRRRELLHTEVQNLMARAEYLKEQVKMRESRWEADTLDKEGLSESVRSSCTLQ

SEQ ID NO: 741435 - protein, 494 aa, Homo sapiens; identical to SEQ ID NO: 741434

SEQ ID NO: 741436 - protein, 249 aa, Homo sapiens; identical to SEQ ID NO: 741432

SEQ ID NO: 741437 - protein, 171 aa, Homo sapiens
MKWPTAALASRLLGWTVLRPPYPRVPSLPQVTLHPTDGLMAVLYTGGEGRTLGEQHFFHETFVTRWLLGPVPVRFGACSPLSFLAPRRGQGAPAGYFCACPRPASRQLCPGLPFPGPLIPTQLLFALEWGTPTPLSDHPPHSMHSAPQNPPVFLGTHTCPPSWYFRLIPQA

SEQ ID NO: 741438 - protein, 113 aa, Homo sapiens
MGATLGLGSVGSVALCLWLSSPPAGVCLLSRLLCRPPCPCICPSLSLLLGTALWLVSPSFTLSLARHCAVARVSASHPLCCLHIPQMRESRWEADTLDKEGLSESVRSSCTLQ

SEQ ID NO: 741439 - protein, 149 aa, Homo sapiens
VSLRGSCSSASALQFLHERNISHLDLKPQNILLSSLEKPHLKLADFGFAQHMSPWDENTQEGSLVLISPTSVPSGPHTSHSAGLVLEFEPGTGRGRLGDSLTQCPLGHPLLGLPCRRGALGKLFPLSGPGSPHLFNGADTFTAHSMGHL

SEQ ID NO: 741440 - protein, 456 aa, Homo sapiens
MSPQRISNQLHGTIAVVRPGSQACPADRGPANGTPPPLPARSSPPSPAYERGLSLDSFLRASRPSAMTHEAPKLSPKVDRLCLLNRPLSLHLQSPHSSPLAPAAAPSDPRLQDLKAREAEAWEEPTELLGLPSALAGMQDLRLEGALHLLLAQQQLRARARAGSVRPRGQPTPGEMLPSLPVGSDSEGPENEGTRAALAAAGLSGGRHTQPAGPGRAQRTEAAATQDCALDKPLDLSEWGRARGQDTPKPAGQHGSLSPAAAHTASPEPPTQSGPLTRSPQALSNGTKGTRVPEQEEASTPMDPSRPLPGSQLSLSSPGSTEDEDTGRPLPPPHPQPPPHPQPPDLDGHPEPSKAEVLRPESDELDETDTPGSEVGLSSQAEATTSTTGEGPECICTQEHGQGPPRKRKRASEPGDKASKKPSRGRRKLTATEGPGSPRDAEDHSPSPNSSPWEET

SEQ ID NO: 741441 - protein, 382 aa, Homo sapiens
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 741442 - protein, 112 aa, Homo sapiens
HGKSLFEPLQLMWNQKSKKVIFRVAWAGSFSLQDRKVVVTLSLVDMLLGFIAPAFPSPPEPLVTPDQRVWAFIWTLLPPWGHQVLEQENLAGSPHGSLIPPPVPMWNSPGCR

SEQ ID NO: 741443 - protein, 276 aa, Homo sapiens
MDSSREPTLGRLDAAGFWQVWQRFDADEKGYIEEKELDAFFLHMLMKLGTDDTVMKANLHKVKQQFMTTQDASKDGRIRMKELAGMFLSEDENFLLLFRRENPLDSSVEFMQIWRKYDADSSGFISAAELRNFLRDLFLHHKKAISEAKLEEYTGTMMKIFDRNKDGRLDLNDLARILALQENFLLQFKMDACSTEERKRDFEKIFAYYDVSKTGALEGPEVDGFVKDMMELVQPSISGVDLDKFREILLRHCDVNKDGKIQKSELALCLGLKINP

SEQ ID NO: 741444 - protein, 179 aa, Homo sapiens
MDSSREPTLGRLDAAGFWQVWQRFDADEKGYIEEKELDAFFLHMLMKLGTDDTVMKANLHKVKQQFMTTQDASKDGRIRMKELAGMFLSEDENFLLLFRRENPLDSSVEFMQIWRKYDADSSGFISAAELRNFLRDLFLHHKKAISEAKLEEYTGTMMKIFDRNKDGRLDLNDLARCHI

SEQ ID NO: 741445 - protein, 121 aa, Homo sapiens
MRMDTVMKANLHKVKQQFMTTQDASKDGRIRMKELAGMFLSEDENFLLLFRRENPLDSSVEFMQIWRKYDADSSGFISAAELRNFLRDLFLHHKKAISEAKLEEYTGTMDSGSSGKLPSPI

SEQ ID NO: 741446 - protein, 159 aa, Homo sapiens
LPPGCISRPDSGPTPGPNNVFGLSSCPAPSGPGRPTTSLSQAPQAQLRPRGGLSRLSSWPSDDICRPQMASGRWAPLGPAWASRRPPQAQIVPKSVSPGGLCRPGLLPLEGLHGPGLGLGLTADSPRPASSRLTAASPVQSSCLSATSAGPAPACQWPL

SEQ ID NO: 741447 - protein, 104 aa, Homo sapiens
REFGPRASNLEREVRTFSSLEWPSRCPLRAAHQGCAFVSTKPQPLSLLPLKAQNNTAQPCVSSVCRQFPPALQQPRPGSLWREWWRSTGILAAAVLGTDPGAWK

SEQ ID NO: 741448 - protein, 164 aa, Homo sapiens
MRFKSNKSVHYKPYQIGVVKMLSELSLVSIENVEISMKLACILGIHILLDLLLLCAINDELKAFANCRNEIRFQTGSVVGDVDFICPICPISQLEVSLALVCICALPFTKGRPRETPEMAPVSCVSSAAVSTWARQRYDRYLSDENKSLYIQLSTWVEYFRGIK

SEQ ID NO: 741449 - protein, 532 aa, Homo sapiens
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 741450 - protein, 181 aa, Homo sapiens
MDVSLEEREKPFQCEFEGCDRRFANSSDRKKHMHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 741451 - protein, 603 aa, Homo sapiens
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKVPPRRPGGGRGRPRRRCSTGPDHLSRPGRVPRGQGGGGNISGGALPQGPGPTAAALTPSPLWSPLPAFVLQVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 741452 - protein, 149 aa, Homo sapiens
MHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 741453 - protein, 149 aa, Homo sapiens; identical to SEQ ID NO: 741452

SEQ ID NO: 741454 - protein, 541 aa, Homo sapiens
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWHEEQKYPFRSL

SEQ ID NO: 741455 - protein, 220 aa, Homo sapiens [sequence omitted]

SEQ ID NO: 741456 - protein, 544 aa, Homo sapiens
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKSPLVPPPGFVLQVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 741457 - protein, 118 aa, Homo sapiens
NAKDTLWLTPLHRAAASRNEKVLGLLLAHSADVNARDKLWQTPLHVAAANRATKCAEALAPLLSSLNVADRSGRSALHHAVHSGHLETVNLLLNKGASLNVCDKKERQPLHWAAFLDR

SEQ ID NO: 741458 - protein, 83 aa, Homo sapiens
GANVNQPNDKGFTPLHVAAVSTNGALCLELLVNNGADVNYQSKEGKSPLHMAAIHGRFTRSQILIQNGSEIDCADKFGNTPLH

SEQ ID NO: 741459 - protein, 130 aa, Homo sapiens
NAKDTLWLTPLHRAAASRNEKVLGLLLAHSADVNARDKLWQTPLHVAAANRATKCAEALAPLLSSLNVADRSGRSALHHAVHSGHLEVRTVPIQAQLGLSLFLPSYSRFPASGPSSLKEKQPGWLYKHLS

SEQ ID NO: 741460 - protein, 130 aa, Homo sapiens; identical to SEQ ID NO: 741459

SEQ ID NO: 741461 - protein, 126 aa, Homo sapiens
NAKDTLWLTPLHRAAASRNEKVLGLLLAHSADVNARDKLWQTPLHVAAANRATKCAEALAPLLSSLNVADRSGRSALHHAVHSGHLETVNLLLNKGASLNVCDKKERQPLHWAAFLGPPSALVLDR

SEQ ID NO: 741462 - protein, 87 aa, Homo sapiens
IDEPNAFGNTALHIACYLGQDAVAIELVNAGANVNQPNDKGFTPLHVAAVSTNGALCLELLVNNGADVNYQVPEGIRLRPVGSETWI

SEQ ID NO: 741463 - protein, 78 aa, Homo sapiens
YSSFHFLLFYLLLPLSLLSPAPQQKVLGLLLAHSADVNARDKLWQTPLHVAAANRATKCAEALAPLLSSLNVADRSGR

SEQ ID NO: 741464 - protein, 116 aa, Homo sapiens
PLFSRSQNGRSTNSLHCTSGKAADTQCQPMKAAWNGAVPCKGTGAELPKTMRVYFFHQCDLNVRHRVKGDYFGAVKFSEYPAGFWTCMGLLAPLFCPILLYGMGTSSSNACTLIVS

SEQ ID NO: 741465 - protein, 111 aa, Homo sapiens
MVWAKRHFWCGKLQRTQAEVEGWGTVTGGEAGEEGRAEASDPRGLPSWESPGRSFQECDRDCIFEKNYPGGGLGLRLLWECSIASSPLLCFTTLVTCFARRNVISLFNSHL

SEQ ID NO: 741466 - protein, 269 aa, Homo sapiens
TRGQEPGPRRMWPRPRAPPETSGAHRGLGKILRDLTAQVFHPWPPPQVMPEAQGTVSTLRPCPWLWIGGPHQRPGLSPQVVDAGPLGSMGWCRVDPTVACVRHVAVGQFLAGGDPSPDTCRAPSQTLEAWEGLWMPPYTPPRLLSLWFLDRTFRHHETKFAQALPSPWENPAGHGKEECCPPARPDQSRPTCQARPASSWGTREPQASRQEKPPTAEGLVSGGELLLGGVTTGRGSGWGIFNDVVASGHRPLPPPILSCPPHLVTQTVA

SEQ ID NO: 741467 - protein, 73 aa, Homo sapiens
FSFNSMRGGLLLGLVLRGPDEQTLAPVTLQRTPFKVRVAAFGSLGGVETAPSASDKCGPVPEHHPRHQEPIVG

SEQ ID NO: 741468 - protein, 628 aa, Homo sapiens
MAILPLLLCLLPLAPASSPPQSATPSPCPRRCRCQTQSLPLSVLCPGAGLLFVPPSLDRRAAELRLADNFIASVRRRDLANMTGLLHLSLSRNTIRHVAAGAFADLRALRALHLDGNRLTSLGEGQLRGLVNLRHLILSNNQLAALAAGALDDCAETLEDLDLSYNNLEQLPWEALGRLGNVNTLGLDHNLLASVPAGAFSRLHKLARLDMTSNRLTTIPPDPLFSRLPLLARPRGSPASALVLAFGGNPLHCNCELVWLRRLAREDDLEACASPPALGGRYFWAVGEEEFVCEPPVVTHRSPPLAVPAGRPAALRCRAVGDPEPRVRWVSPQGRLLGNSSRARAFPNGTLELLVTEPGDGGIFTCIAANAAGEATAAVELTVGPPPPPQLANSTSCDPPRDGDPDALTPPSAASASAKVADTGPPTDRGVQVTEHGATAALVQWPDQRPIPGIRMYQIQYNSSADDILVYRMIPAESRSFLLTDLASGRTYDLCVLAVYEDSATGLTATRPVGCARFSTEPALRPCGAPHAPFLGGTMIIALGGVIVASVLVFIFVLLMRYKVHGGQPPGKAKIPAPVSSVCSQTNGALGPTPTPAPPAPEPAALRAHTVVQLDCEPWGPGHEPVGP

SEQ ID NO: 741469 - protein, 104 aa, Homo sapiens
TAAVELTVGPPPPPQLANSTSCDPPRDGDPDALTPPSAASASAKVADTGPPTDRGVQVTEHGATAALVQWPDQRPIPGIRMYQIQYNSSADDILVYRCRVQALG

SEQ ID NO: 741470 - protein, 151 aa, Homo sapiens
ARLLLHARPGGGGHSNQRKMSLEQEEETQPGRLLGRRDAVPAFIEPNVRFWITERQVRPGPGATRGREGAGRAAWSRADPGDLGQATWAPPVSVSSSRSCAGNAHHRPSPLRAREGTQGKSKLPDAHDHNVTLQIALSEGPSPRRWLLPTA

SEQ ID NO: 741471 - protein, 356 aa, Homo sapiens
ARLLLHARPGGGGHSNQRKMSLEQEEETQPGRLLGRRDAVPAFIEPNVRFWITERQSFIRRFLQWTELLDPTNVFISVESIENSRQLLCTNEDVSSPASADQRIQEAWKRSLATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 741472 - protein, 356 aa, Homo sapiens; identical to SEQ ID NO: 741471

SEQ ID NO: 741473 - protein, 151 aa, Homo sapiens; identical to SEQ ID NO: 741470

SEQ ID NO: 741474 - protein, 151 aa, Homo sapiens; identical to SEQ ID NO: 741470

SEQ ID NO: 741475 - protein, 347 aa, Homo sapiens
ARLLLHARPGGGGHSNQRKMSLEQEEETQPGRLLGRRDAVPAFIEPNVRFWITERQSFIRRFLQWTELLDPTNVFISVESIENSRQLLCTNEDVSSPASADQRATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 741476 - protein, 221 aa, Homo sapiens
MAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 741477 - protein, 356 aa, Homo sapiens; identical to SEQ ID NO: 741471

SEQ ID NO: 741478 - protein, 151 aa, Homo sapiens; identical to SEQ ID NO: 741470

SEQ ID NO: 741479 - protein, 333 aa, Homo sapiens
ARLLLHARPGGGGHSNQRKMSLEQEEETQPGRLLGRRDAVPAFIEPNVRFWITERQSFIRRFLQWTELLDPTNVFISVESIENSRQLLCTNEDVSSPASADQRIQEAWKRSLATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQVT

SEQ ID NO: 741480 - protein, 356 aa, Homo sapiens; identical to SEQ ID NO: 741471

SEQ ID NO: 741481 - protein, 338 aa, Homo sapiens
ARLLLHARPGGGGHSNQRKMSLEQEEETQPGRLLGRRDAVPAFIEPNVRFWITERQSFIRRFLQWTELLDPTNVFISVESIENSRQLLCTNEDVSSPASADQRIQEAWKRSLATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 741482 - protein, 333 aa, Homo sapiens; identical to SEQ ID NO: 741479

SEQ ID NO: 741483 - protein, 342 aa, Homo sapiens
ARLLLHARPGGGGHSNQRKMSLEQEEETQPGRLLGRRDAVPAFIEPNVRFWITERQSFIRRFLQWTELLDPTNVFISVESIENSRQLLCTNEDVSSPASADQRIQEAWKRSLATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEREF

SEQ ID NO: 741484 - protein, 143 aa, Homo sapiens
MRDADADAGGGADGGDGRGGHSCRGGVDTAAAPAGGAPPAHAPGPGRDAASAARGSRMRPHIFTLSVPFPTPLEAEIAHGSLAPDAEPHQRVVGKDLTVSGRILVVRWKAEDCRLLRISVINFLDQLSLVVRTMQRFGPPVSR

SEQ ID NO: 741485 - protein, 143 aa, Homo sapiens; identical to SEQ ID NO: 741484

SEQ ID NO: 741486 - protein, 143 aa, Homo sapiens; identical to SEQ ID NO: 741484

SEQ ID NO: 741487 - protein, 131 aa, Homo sapiens
MQTQAEALTAGMAGVATAAAGAWTQPQLRPVELPQRTRQVRAETPRLRPGGHECGRTYSPSACLSRPPWRRKSPMGPWHQMPSPTKGWLGRISHRWKAEDCRLLRISVINFLDQLSLVVRTMQRFGPPVSR

SEQ ID NO: 741488 - protein, 143 aa, Homo sapiens; identical to SEQ ID NO: 741484

SEQ ID NO: 741489 - protein, 131 aa, Homo sapiens; identical to SEQ ID NO: 741487

SEQ ID NO: 741490 - protein, 207 aa, Homo sapiens
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 741491 - protein, 101 aa, Homo sapiens
LREKNHTFPSSRGFLLVPCFLQANSKMFSLFFLSFFLFFFFFQKRCGGKVFQNQRLSTQQYKYKFFIPASRIPPLQPCLLTGIMKQLNSGVKKFHPVVEVQ

SEQ ID NO: 741492 - protein, 241 aa, Homo sapiens
EGRCSRIAKNAEGASGKTLLIYHGYTFPRDNFTKMSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 741493 - protein, 207 aa, Homo sapiens; identical to SEQ ID NO: 741490

SEQ ID NO: 741494 - protein, 267 aa, Homo sapiens
QPCRVPAALFVLAARGRTRAPPGEGRCGERARERAGTARARRASAARAPPPVFQEITSAKMSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 741495 - protein, 240 aa, Homo sapiens
FVRGGVGVGGGGSWLQRSLNFHRYSFPRDNFTKMSSDRQRSDDESPSTSSGSSDADHRDPAAPEPEEQEERKPSATQQKKNTKLSSKTTVFLFTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 741496 - protein, 297 aa, Homo sapiens
MSSDRQRSDDESPSTSSGSSDADQRDPAAPEPEEQEERKPSATQQKKNTKLSSKTTAKLSTSAKRIQKELAEITLDPPPNCSFPRDNFTKMSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 741497 - protein, 207 aa, Homo sapiens; identical to SEQ ID NO: 741490

SEQ ID NO: 741498 - protein, 207 aa, Homo sapiens; identical to SEQ ID NO: 741490

SEQ ID NO: 741499 - protein, 207 aa, Homo sapiens; identical to SEQ ID NO: 741490

SEQ ID NO: 741500 - protein, 207 aa, Homo sapiens; identical to SEQ ID NO: 741490

SEQ ID NO: 741501 - protein, 99 aa, Homo sapiens
WFWHEHGHTFHQIQKPPKVTFRTRIYHCNINSQGVICLDILKDNWSPALTISKVLLSICSLLTDCNPADPLVGSIATQYLTNRAEHDRIARQWTKRYAT

SEQ ID NO: 741502 - protein, 207 aa, Homo sapiens; identical to SEQ ID NO: 741490

SEQ ID NO: 741503 - protein, 238 aa, Homo sapiens
MDLLNYQYLDKMNNNIGILCYDSFPRDNFTKMSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 741504 - protein, 248 aa, Homo sapiens
MKSYGQVHAVTGNDNYITNAAWLRVIKTSLIGSFPRDNFTKMSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 741505 - protein, 149 aa, Homo sapiens
TNGRRCEIRKKVICSDSLFYHRYSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 741506 - protein, 207 aa, Homo sapiens; identical to SEQ ID NO: 741490

SEQ ID NO: 741507 - protein, 207 aa, Homo sapiens; identical to SEQ ID NO: 741490

SEQ ID NO: 741508 - protein, 207 aa, Homo sapiens; identical to SEQ ID NO: 741490

SEQ ID NO: 741509 - protein, 78 aa, Homo sapiens
VRYRQSRLEQSGGVICLDILKDNWSPALTISKVLLSICSLLTDCNPADPLVGSIATQYLTNRAEHDRIARQWTKRYAT

SEQ ID NO: 741510 - protein, 207 aa, Homo sapiens; identical to SEQ ID NO: 741490

SEQ ID NO: 741511 - protein, 462 aa, Homo sapiens [sequence omitted]

SEQ ID NO: 741512 - protein, 208 aa, Homo sapiens [sequence omitted]

SEQ ID NO: 741513 - protein, 360 aa, Homo sapiens
MLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQFQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 741514 - protein, 501 aa, Homo sapiens
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTLDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDESRSVARLECSGAISAISNLRLPGSSNSPASASRVAGTTALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQFQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 741515 - protein, 462 aa, Homo sapiens [sequence omitted]

SEQ ID NO: 741516 - protein, 462 aa, Homo sapiens [sequence omitted]

SEQ ID NO: 741517 - protein, 234 aa, Homo sapiens [sequence omitted]

SEQ ID NO: 741518 - protein, 295 aa, Homo sapiens
MLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTILEDSMIFSLASCIITAKLCTWAICFLTTSEEVQKKLYEEINQVFGNGPVTPEKIEQLRYCQHVLCETVRTAKLTPVSAQFQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 741519 - protein, 462 aa, Homo sapiens [sequence omitted]

SEQ ID NO: 741520 - protein, 298 aa, Homo sapiens [sequence omitted]

SEQ ID NO: 741521 - protein, 299 aa, Homo sapiens
MWLPWALLLLWVPGCFALSKCRTVAGPVGGSLSVQCPYEKEHRTLNKYWCRPPQIFLCDKIVETKGSAGKRNGRVSIRDSPANLSFTVTLENLTEEDAGTYWCGVDTPWLRDFHDPVVEVEVSVFPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 741522 - protein, 299 aa, Homo sapiens; identical to SEQ ID NO: 741521

SEQ ID NO: 741523 - protein, 169 aa, Homo sapiens
MTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 741524 - protein, 150 aa, Homo sapiens
MWLPWALLLLWVPASTSMTPASITAAKTSTITTAFPPVSSTTLFAVGATHSASIQEETEEVVNSQLPLLLSLLALLLLLLVGASLLAWRMFQKWIKAGDHSELSQNPKQASPREELHYASVVFDSNTNRIAAQRPREEEPDSDYSVIRKT

SEQ ID NO: 741525 - protein, 169 aa, Homo sapiens; identical to SEQ ID NO: 741523

SEQ ID NO: 741526 - protein, 103 aa, Homo sapiens
MWLPWALLLLWVPAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 741527 - protein, 130 aa, Homo sapiens
MTGSPLPAPVQALHPGNSEAMLLSSPPLHSCCLWVLFLSWSLLGLVSPVLSSSGVLISSFLIRPFGVSLLVVPDIGRQLGAVPGGAALAASSWHHRVPGFPATPASLSLLLLGSGPTGSVHGGGYTQLFP

SEQ ID NO: 741528 - protein, 130 aa, Homo sapiens; identical to SEQ ID NO: 741527

SEQ ID NO: 741529 - protein, 963 aa, Homo sapiens
QTRPAPETAPARARDTLSAMTVSGPGTPEPRPATPGASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741530 - protein, 929 aa, Homo sapiens
MTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741531 - protein, 349 aa, Homo sapiens
MSCSNVETTGAPWRPTLRPWVWTRRPRTRPFCTGTGPPATSSWKITTKQKQRHPKVGEWWALVWSCRASVVGKDSGTAAPSHSPPLAPETHLPSFFPTASGLSFSAATLTFSEAEAPSPTFVPPTFFWPFLEIFPYCSCLETVASWVLTALLFVLTIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRVGGVERLVTASVPLSVCPSIPPSTHLSIRPSARPSIHPLFHPLPLTLF

SEQ ID NO: 741532 - protein, 947 aa, Homo sapiens
AGTVRNSGIARARDTLSAMTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741533 - protein, 710 aa, Homo sapiens
MVRNSGIARARDTLSAMTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRVSWFTHPFLMAEPSAYKT

SEQ ID NO: 741534 - protein, 947 aa, Homo sapiens; identical to SEQ ID NO: 741532

SEQ ID NO: 741535 - protein, 1047 aa, Homo sapiens
MVRNSGIARARDTLSAMTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVGEWKQVWGLLDVTVMEGMGLSQPGQFFGDQTCSCRLFGIRFGDIILLRFSATKVPQDKAGAQSGAWDADPPFPVSPWFVGEVEEVKLGWAAVEPTDVFLLLPDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741536 - protein, 1016 aa, Homo sapiens
MSCSNVETTGAPWRPTLRPWVWTRRPRTRPFCTGTGPPATSSWKITTKQKQRHPKVGEWWALVWSCRASVVGKDSGTAAPSHSPPLAPETHLPSFFPTASGLSFSAATLTFSEAEAPSPTFVPPTFFWPFLEIFPYCSCLETVASWVLTALLFVLTIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741537 - protein, 799 aa, Homo sapiens
MSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741538 - protein, 506 aa, Homo sapiens
MESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741539 - protein, 812 aa, Homo sapiens
PRNSGQTHREVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741540 - protein, 828 aa, Homo sapiens
ISAFFVVRKTWNLPECPAIEEWLNKWVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741541 - protein, 947 aa, Homo sapiens; identical to SEQ ID NO: 741532

SEQ ID NO: 741542 - protein, 947 aa, Homo sapiens; identical to SEQ ID NO: 741532

SEQ ID NO: 741543 - protein, 318 aa, Homo sapiens
RSRGRVLMDEEKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741544 - protein, 947 aa, Homo sapiens; identical to SEQ ID NO: 741532

SEQ ID NO: 741545 - protein, 282 aa, Homo sapiens
MARYELVVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 741546 - protein, 369 aa, Homo sapiens
MVRNSGIARARDTLSAMTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSR

SEQ ID NO: 741547 - protein, 347 aa, Homo sapiens
AGTVRNSGIARARDTLSAMTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGR

SEQ ID NO: 741548 - protein, 361 aa, Homo sapiens
MVRNSGIARARDTLSAMTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGGGAAGGRGGSDPCSRQG

SEQ ID NO: 741549 - protein, 116 aa, Homo sapiens
RAAVTVVQKKGPSELRLQPAWTKQWNMGLSNPTKMESEGVVPGPKAHAHATYCGTESKDGSSFGWWWLACPILLPILACCPRMSSVLSQRPRSVTQPCLASTACSLTQRGPFSVLL

SEQ ID NO: 741550 - protein, 65 aa, Homo sapiens
MTKGRSQPGQAALLTTLPKEEALVEKHFHLQFSPRSAERNSAECNATVKDHFLQSPGPREGVEDP

SEQ ID NO: 741551 - protein, 111 aa, Homo sapiens
TTKFAAASTASRVRRRRPQKTPPTSRVRRQRPKKTAPTSRVRRQRPKKAALASRVRRRRPQKTALVSRIRSCRLQKTALANRVRRRRPQKTAPTGPGQRTNVDAAANLVVV

SEQ ID NO: 741552 - protein, 437 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 741553 - protein, 464 aa, Homo sapiens
MRRQRFAGDRMDLFPHGRDQSTARLCTARREPRKKQRIETQAHDGGGQEEPAPSDLTSAASARGEGAPALPVRSRKYEAEGTKNGGPDCCGCGGDEKPGRRGSLPTRRPEAKQPKASADISSCPLNPALRLGGSGRLRDARSRGGTGEGPRARISREHERAEALSEQDAVRGCLGPPERRSGGSRAALGHRKRQARRSWSTAFCRKRLHPPQLEPTAWRLYQVASGDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 741554 - protein, 107 aa, Homo sapiens
MSEVGLPACELGADLSGSAVHVLSVPRTLSDSTGSEKDDLYPNGSGNGSAESSHFFAYLVTAAILVAVLYIAHHNKRKIIAFVLEGKRSKVTRRPKASDYQRLDQKS

SEQ ID NO: 741555 - protein, 82 aa, Homo sapiens
RSRGSLMLGSEKDDLYPNGSGNGSAESSHFFAYLVTAAILVAVLYIAHHNKRKIIAFVLEGKRSKVTRRPKASDYQRLDQKS

SEQ ID NO: 741556 - protein, 437 aa, Homo sapiens; identical to SEQ ID NO: 741552

SEQ ID NO: 741557 - protein, 437 aa, Homo sapiens; identical to SEQ ID NO: 741552

SEQ ID NO: 741558 - protein, 104 aa, Homo sapiens
DAWVEPTRRTTRAQPLAMLSYLLSMVTFLRTSRVQFLLAERFSFSMPYGCDSNEGSHSFSWLPLAVTLYMLGFALKEESRKKGWFQKPRGSAVDAYILSRSPQS

SEQ ID NO: 741559 - protein, 265 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTLQTRQSLNSNDFMTPLPSKHS

SEQ ID NO: 741560 - protein, 455 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKYVLILNVFPAPPKRSFLPS

SEQ ID NO: 741561 - protein, 379 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 741562 - protein, 437 aa, Homo sapiens; identical to SEQ ID NO: 741552

SEQ ID NO: 741563 - protein, 437 aa, Homo sapiens; identical to SEQ ID NO: 741552

SEQ ID NO: 741564 - protein, 437 aa, Homo sapiens; identical to SEQ ID NO: 741552

SEQ ID NO: 741565 - protein, 437 aa, Homo sapiens; identical to SEQ ID NO: 741552

SEQ ID NO: 741566 - protein, 125 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTGV

SEQ ID NO: 741567 - protein, 114 aa, Homo sapiens
MPVIPASQLLWRLKQENHLNLGDGGCGEPRSRHCTPAWATRTKLHLRKKERKKAKQKQSMPEVYSKPLTVGVLKSTWWMKEETKFRGLGRITECGEMFPKGTSSHAANVLSGEY

SEQ ID NO: 741568 - protein, 270 aa, Homo sapiens
GLKGASMGGAQLELPSGARPGVCVRRSFRAHAGDQPRRPPGPIPVPGTMKQESAAPNTPPTSQSPTPSAQFPRNDGDPQALWIFGYGSLVWRPDFAYSDSRVGFVRGYSRRFWQGDTFHRGSDKMPGRVVTLLEDHEGCTWGVAYQVQGEQVSKALKYLNVREAVLGGYDTKEVTFYPQDAPDQPLKALAYVATPQNPGYLGPAPEEAIATQILACRGFSGHNLEYLLRLADFMQLCGPQAQDEHLAAIVDAVGTMLPCFCPTEQALALV

SEQ ID NO: 741569 - protein, 270 aa, Homo sapiens; identical to SEQ ID NO: 741568

SEQ ID NO: 741570 - protein, 152 aa, Homo sapiens
NISSLPEPGRVVTLLEDHEGCTWGVAYQVQGEQVSKALKYLNVREAVLGGYDTKEVTFYPQDAPDQPLKALAYVATPQNPGYLGPAPEEAIATQILACRGFSGHNLEYLLRLADFMQLCGPQAQDEHLAAIVDAVGTMLPCFCPTEQALALV

SEQ ID NO: 741571 - protein, 270 aa, Homo sapiens; identical to SEQ ID NO: 741568

SEQ ID NO: 741572 - protein, 1857 aa, Homo sapiens
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVVSAPLPRPGTSLELCRKALARQRARDLSETASALLAKDKQIAALQRECRELQARLTLVGKEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQRTRRRRVQC

SEQ ID NO: 741573 - protein, 1976 aa, Homo sapiens
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGMTCCCPSPTSHQPPSNSILTLSNCCVWGAPTYPDSSRALEPALNPAAEWSDCTWAGRVEWASVAEGNTAMQPGILGPGGWVGLLSGMGDECPYETSSVTQHGPERKLQSPSPVSPTSPASLSLCFSGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQDWGCTTQGSPGPPGGPCTPSSGSAPRIERGEPQGRSEKVWGFFSKGKQLLRRLGSGKKE

SEQ ID NO: 741574 - protein, 1838 aa, Homo sapiens
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQDWGCTTQGSPGPPGGPCTPSSGSAPRIERGEPQGRSEKVWGFFSKGKQLLRRLGSGKKE

SEQ ID NO: 741575 - protein, 418 aa, Homo sapiens
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQVGRQ

SEQ ID NO: 741576 - protein, 1797 aa, Homo sapiens
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQRTRRRRVQC

SEQ ID NO: 741577 - protein, 1976 aa, Homo sapiens; identical to SEQ ID NO: 741573

SEQ ID NO: 741578 - protein, 88 aa, Homo sapiens
DTAELGVHLVNSLVDHGRNSDLSDIQEEEEEEEEEEEEELGSRTCSFQKQVAGNSIRENGAKVNGVGMGCWAPGLKLRGLPTVCQQVL

SEQ ID NO: 741579 - protein, 258 aa, Homo sapiens
CCPHARGALDWRSMAQEEGGSLPEVRARVRAAHGIPDLAQKLHFYDRWAPDYDQDVATLLYRAPRLAVDCLTQALPGPPHSALILDVACGTGLVAAELRAPGFLQLHGVDGSPGMLEQAQAPGLYQRLSLCTLGQEPLPSPEGTFDAVLIVGALSDGQVPCNAIPELHVTKPGGLVCLTTRTNWSNLQYKEALEATLDRLEQAGMWEGLVAWPVDRLWTAGSWLPPSWRWYPASLPRMASSPALSTCTESGRRPRLRK

SEQ ID NO: 741580 - protein, 143 aa, Homo sapiens
HSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGRLGAWSVSLGGWG

SEQ ID NO: 741581 - protein, 134 aa, Homo sapiens
HSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGVEVPH

SEQ ID NO: 741582 - protein, 134 aa, Homo sapiens; identical to SEQ ID NO: 741581

SEQ ID NO: 741583 - protein, 100 aa, Homo sapiens
HSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVPNLPA

SEQ ID NO: 741584 - protein, 50 aa, Homo sapiens
RGRACSLGGGTVGGGGDQGSVLGVLGWVSRLGPRRRSRALFPGSAGSRGD

SEQ ID NO: 741585 - protein, 99 aa, Homo sapiens
GSTVAPALAVAVGEGRAAPFLRLIRLSRGLSESPGVRGFGGCVTVAKHSHRPGPQLGACAQEPAVCSWSSPTVEQPRGRGPGNRRGGCAVHTQRVVRAT

SEQ ID NO: 741586 - protein, 303 aa, Homo sapiens
RAGAGRGVPGRGVVRTGPGLGRPREAWACQAVPSGSRPPSSSVEFRPGPAHSSALGAPSTCGRPGSAILRRLAIPNAMAAVAVLRAFGASGPMCLRRGPWAQLPARFCSRDPAGAGRRESEPRPTSARQLDGIRNIVLSNPKKRNTLSLAMLKSLQSDILHDADSNDLKVIIISAEGPVFSSGHDLKELTEEQGRDYHAEVFQTCSKVMMHIRNHPVPVIAMVNGLATAAGCQLVASCDIAVASDKSSFATPGVNVGLFCSTPGVALARAVPRKSLALSPRLEYSGAISAHCNVQGILLPQPP

SEQ ID NO: 741587 - protein, 415 aa, Homo sapiens
RAGAGRGVPGRGVVRTGPGLGRPREAWACQAVPSGSRPPSSSVEFRPGPAHSSALGAPSTCGRPGSAILRRLAIPNAMAAVAVLRAFGASGPMCLRRGPWAQLPARFCSRDPAGAGRRESEPRPTSARQLDGIRSAPGRAGSSRWCRVGVRAPPLTRGGPGEPEPRLRPWGGNSPCPGPGPGSETRRNIVLSNPKKRNTLSLAMLKSLQSDILHDADSNDLKVIIISAEGPVFSSGHDLKELTEEQGRDYHAEVFQTCSKLATAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 741588 - protein, 380 aa, Homo sapiens
RAGAGRGVPGRGVVRTGPGLGRPREAWACQAVPSGSRPPSSSVEFRPGPAHSSALGAPSTCGRPGSAILRRLAIPNAMAAVAVLRAFGASGPMCLRRGPWAQLPARFCSRDPAGAGRRESEPRPTSARQLDGIRNIVLSNPKKRNTLSLAMLKSLQSDILHDADSNDLKVIIISAEGPVFSSGHDLKELTEEQGRDYHAEVFQTCSKVMMHIRNHPVPVIAMVNGLATAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 741589 - protein, 433 aa, Homo sapiens
RAGAGRGVPGRGVVRTGPGLGRPREAWACQAVPSGSRPPSSSVEFRPGPAHSSALGAPSTCGRPGSAILRRLAIPNAMAAVAVLRAFGASGPMCLRRGPWAQLPARFCSRDPAGAGRRESEPRPTSARQLDGIRSAPGRAGSSRWCRVGVRAPPLTRGGPGEPEPRLRPWGGNSPCPGPGPGSETRRNIVLSNPKKRNTLSLAMLKSLQSDILHDADSNDLKVIIISAEGPVFSSGHDLKELTEEQGRDYHAEVFQTCSKVMMHIRNHPVPVIAMVNGLATAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 741590 - protein, 56 aa, Homo sapiens
AEWWLGMEAKAAPKPAASGACSVSAEETEKWMEEAMHMILCYAQCFHVGHVISPTE

SEQ ID NO: 741591 - protein, 197 aa, Homo sapiens
AEWWLGMEAKAAPKPAASGACSVSAEETEKWMEEAMHMAKEALENTEVPVGCLMVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 741592 - protein, 100 aa, Homo sapiens
PMEDDEDRDEDEEDEEDKEEVWMKLPQIESKYKISYSIVSFQDQEKLGDSHLVSTAFPQYHVKVLAFILFHLFHFESCLLAPAQLPRDNSLGPRAAPEWD

SEQ ID NO: 741593 - protein, 103 aa, Homo sapiens
MGQSYSQLGIMCIIHTWNTVWYHYSILQMKKMRLPKVMSFRGRVSPHLTLGQSDLLTESVIFRLDHRTVGFCGPVRETGGYQAGRQGLQPDQPGACYKATLDE

SEQ ID NO: 741594 - protein, 133 aa, Homo sapiens
KNGSNSTVLFKQGIYFLFLFYPFHDLVLFQALSQSQMDLNSPEQRQPRATQLSCPLCGITLSLCPTESPPHFPFPALLPFCKCKTSFPLNCITEIASERAFLQLISSVSNSSSILHPKSSCHCLQNLKLIPKL

SEQ ID NO: 741595 - protein, 66 aa, Homo sapiens
LQIPGVAGLKAEMRGLLTWELFIANAAWLQFLRPAAVGPACKRTVTTPRRCSPPGVTLLQKTQLPK

SEQ ID NO: 741596 - protein, 1214 aa, Homo sapiens
AAAGEGWGAPTQSEPRRGRLRLTQRFPRAASAHPRPHQPPPGGCTRAGEEGATVRVGGAGWVPEVTSSAVEAGAAEAELRSCWVHRPLPSAREVTNVKDVAEVFQKWLKIEGKKCHCLSEKTKQNMGNTTTKFRKALINGDENLACQIYENNPQLKESLDPNTSYGEPYQHNTPLHYAARHGMNKILGTFLGRDGNPNKRNVHNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVVSSASMSVLHSSSLRDYTPASRSENQDSLQALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 741597 - protein, 1241 aa, Homo sapiens
AAAGEGWGAPTQSEPRRGRLRLTQRFPRAASAHPRPHQPPPGGCTRAGEEGATVRVGGAGWVPEVTSSAVEAGAAEAELRSCWVHRPLPSAREVTNVKDVAEVFQKWLKIEGKKCHCLSEKTKQNMGNTTTKFRKALINGDENLACQIYENNPQLKESLDPNTSYGEPYQHNTPLHYAARHGMNKILGTFLGRDGNPNKRNVHNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREYLTALKVIAGLFSLKMEQFIFATGKRKPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVVSSASMSVLHSSSLRDYTPASRSENQDSLQALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 741598 - protein, 1214 aa, Homo sapiens; identical to SEQ ID NO: 741596

SEQ ID NO: 741599 - protein, 1002 aa, Homo sapiens
IFTLVKFCSFPFEDHLQTICSNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 741600 - protein, 1214 aa, Homo sapiens; identical to SEQ ID NO: 741596

SEQ ID NO: 741601 - protein, 1014 aa, Homo sapiens
IFTLVKFCSFPFEDHLQTICSNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWNQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVVSSASMSVLHSSSLRDYTPASRSENQDSLQALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 741602 - protein, 798 aa, Homo sapiens
IFTLVKFCSFPFEDHLQTICSNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVVSSASMSVLHSSSLRDYTPASRSENQDSLQALSSLDEDDPQ

SEQ ID NO: 741603 - protein, 349 aa, Homo sapiens
AAAGEGWGAPTQSEPRRGRLRLTQRFPRAASAHPRPHQPPPGGCTRAGEEGATVRVGGAGWVPEVTSSAVEAGAAEAELRSCWVHRPLPSAREVTNVKDVAEVFQKWLKIEGKKCHCLSEKTKQNMGNTTTKFRKALINGDENLACQIYENNPQLKESLDPNTSYGEPYQHNTPLHYAARHGMNKILGTFLGRDGNPNKRNVHNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREY

SEQ ID NO: 741604 - protein, 1032 aa, Homo sapiens
IFTLVKFCSFPFEDHLQTICSNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVVSSASMSVLHSSSLRDYTPASRSENQDSLQALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 741605 - protein, 1214 aa, Homo sapiens; identical to SEQ ID NO: 741596

SEQ ID NO: 741606 - protein, 723 aa, Homo sapiens
IFTLVKFCSFPFEDHLQTICSNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRRNMLNFSIGGGTDNVVEEMFTVYSVILQTLMSQVKAL

SEQ ID NO: 741607 - protein, 1026 aa, Homo sapiens
IFTLVKFCSFPFEDHLQTICSNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEYRRRHRQRRRGDVHSLLSNPPDPDEPSESTLDIPEGGSSSRRPGTSVVSSASMSVLHSSSLRDYTPASRSENQDSLQALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 741608 - protein, 1032 aa, Homo sapiens; identical to SEQ ID NO: 741604

SEQ ID NO: 741609 - protein, 274 aa, Homo sapiens
MHLCGGNGLLTQTDPKEQQRQLKKQKNRAAAQRSRQKHTDKADALHQQHESLEKDNLALRKEIQSLQAELAWWSRTLHVHERLCPMDCASCSAPGLLGCWDQAEGLLGPGPQGQHGCREQLELFQTPGSCYPAQPLSPGPQPHDSPSLLQCPLPSLSLGPAVVAEPPVQLSPSPLLFASHTGSSLQGSSSKLSALQPSLTAQTAPPQPLELEHPTRGKLGSSPDNPSSALGLARLQSREHKPALSAATWQGLVVDPSPHPLLAFPLLSSAQVHF

SEQ ID NO: 741610 - protein, 176 aa, Homo sapiens
MHLCGGNGLLTQTDPKEQQRQLKKQKNRAAAQRSRQKHTDKADALHQQHESLEKDNLALRKEIQSLQAELAWWSRTLHVHERLCPMDCASCSAPGLLGCWDQAEGLLGPGPQGQHGCREQLELFQTPGSCYPAQPLSPGPQPHDSPLYLTAPTPVWPPGPHHPQTPPKQFPHCSLD

SEQ ID NO: 741611 - protein, 282 aa, Homo sapiens
GDRRSELQPLHRPGILPQGICSTSLWKKTTSPCGRRSSPCRPSWRGGAGPCTCMSACAPWIVPPAQLQGSWAAGTRLRGSWALAHRDNMAAGSSWSCSRPRVPVTQLSRSLQVHSLMILPASSSAPCPHCPLAPLWLLNLLSSCPPALSCLPRTLVPACRGLPLSSVPSSPASRPKLPLHSPSSWSIPPEGSWGPLPTTLPLPWGLHVCRAGSTNLLSQQPLGKGWLWIPALTLSWPFLCSPLLKSTSNLVFGAGLAPSLGSGSSLSTRASPPSLLGAALRG

SEQ ID NO: 741612 - protein, 274 aa, Homo sapiens; identical to SEQ ID NO: 741609

SEQ ID NO: 741613 - protein, 91 aa, Homo sapiens
HTPTQEEERRGDKPWHDEPGLMDEAGRRSCRASSLCPVSLLGSPLPSLAGCHGQELSAFLCATTYPFSEKPVLRKDLINSFTLRCKRLMRP

SEQ ID NO: 741614 - protein, 129 aa, Homo sapiens
SVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKMARS

SEQ ID NO: 741615 - protein, 454 aa, Homo sapiens
SVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAEV

SEQ ID NO: 741616 - protein, 454 aa, Homo sapiens; identical to SEQ ID NO: 741615

SEQ ID NO: 741617 - protein, 454 aa, Homo sapiens; identical to SEQ ID NO: 741615

SEQ ID NO: 741618 - protein, 401 aa, Homo sapiens
SVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKGL

SEQ ID NO: 741619 - protein, 125 aa, Homo sapiens
MPGPCLSQQHPFLSLSLFPFCLWICLARSLGSGIFARLSQLLPSPASWGWDFLTLRQAQQMLGPSLCPGHSTSAHQHYGAYVLPRDLCSFLLTSTVRARRPSRTPESPVSSAPSKCLFVYDVPLL

SEQ ID NO: 741620 - protein, 208 aa, Homo sapiens
YLSGPVLSGLYSRARTLEIRTPRRHRKHHLQPRGLSGDRNLTPRWTLRCDKPRQDRPASLRLKGPPSCQAPASHSSTLSSHCPCSLFACGSVWPGPWGQEYLQDSASSFPAQPLGAGTFSPCGRHNRCWDPVSAQVTAQVHISTMGPMSCPETSAPSCSHPQSGHGAPQELQSHLSHRLPASASLSMMSPFSEAWTHPSLSLGPAPSH

SEQ ID NO: 741621 - protein, 454 aa, Homo sapiens; identical to SEQ ID NO: 741615

SEQ ID NO: 741622 - protein, 179 aa, Homo sapiens
SPSIPDTPLTCANSSLPHRCDKPRQDRPASLRLKGPPSCQAPASHSSTLSSHCPCSLFACGSVWPGPWGQEYLQDSASSFPAQPLGAGTFSPCGRHNRCWDPVSAQVTAQVHISTMGPMSCPETSAPSCSHPQSGHGAPQELQSHLSHRLPASASLSMMSPFSEAWTHPSLSLGPAPSH

SEQ ID NO: 741623 - protein, 454 aa, Homo sapiens; identical to SEQ ID NO: 741615

SEQ ID NO: 741624 - protein, 507 aa, Homo sapiens
SVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAEVNGGEEPGPTAEGHGVLWETPSSPCAHTNWPAIAQSTQNAPIPAHADWSEPTVR

SEQ ID NO: 741625 - protein, 48 aa, Homo sapiens
GVSRALWSLVLVSGLHPDTLNQEAQKASSATERTQWGQKSDSSLDAEV

SEQ ID NO: 741626 - protein, 202 aa, Homo sapiens
GWGWMDRWMDGWTDGVGEGRKGGRKEGILAPSLRALVGRAETGHSAQPGHPHEGSQVTLVAQIALRTWRDRPESGSPPLPLSSLLFPQAWEQSIPQPCHLPYSSLFHSFPFLAPSALPVFPECLRGERDPHLPKEMSFWGTTSHRSPPHPTTPPTWPLAKSQAELATGKAEPQERHSTIYTLLYILFLLYIHSVHVGVNAVK

SEQ ID NO: 741627 - protein, 202 aa, Homo sapiens; identical to SEQ ID NO: 741626

SEQ ID NO: 741628 - protein, 104 aa, Homo sapiens
MSLCSRVTVLSPGTVPEFSKLKPGLHSPSQTPAELSNHPLLPSLQEPWHPCSGESLKSNLKVPTVFPQIWVSMSMGHQSGEPHACPCLAQDCHSVRFHIALLDP

SEQ ID NO: 741629 - protein, 107 aa, Homo sapiens
IPNLPTTHGHRKASHDLAPLPGQTHHLSLCSSAVLNLCFSRTSRSQNTPYFFTFACPHPLLKTGSPYCAFVEIRKRCHIPLVRLDSRPHSSLDWHHTALTNLHTIST

SEQ ID NO: 741630 - protein, 113 aa, Homo sapiens
TSIVFSTLAVPFYILTNNAQGFQFLHILTNICSFLVFIFNRSSPNGCEVISHYGFGSHFSSDVGHLFMYSLVKCLSCLENCLFKSFVIMVFFLMLAIILVSLVGLRCYFPQYI

SEQ ID NO: 741631 - protein, 271 aa, Homo sapiens
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQTASGDMQTYQIRTTPSATSLPQTVVMTSPVTLTSQTTKTDDPQLKREIRLMKNREAARECRRKKKEYVKCLENRVAVLENQNKTLIEELKTLKDLYSNKSV

SEQ ID NO: 741632 - protein, 271 aa, Homo sapiens; identical to SEQ ID NO: 741631

SEQ ID NO: 741633 - protein, 271 aa, Homo sapiens; identical to SEQ ID NO: 741631

SEQ ID NO: 741634 - protein, 271 aa, Homo sapiens; identical to SEQ ID NO: 741631

SEQ ID NO: 741635 - protein, 271 aa, Homo sapiens; identical to SEQ ID NO: 741631

SEQ ID NO: 741636 - protein, 129 aa, Homo sapiens
HTDGKAGSFAISGHHWVQRLADLGLNPGFSEPSFPHLCLSLKHLRITSKVFRFNVSSVEKNRTNLFRAEFRVLRVPNPSSKRNEQRIELFQVTPLSEQKPHRRESWFLCHIRAPLGAAFGRPGFESWLL

SEQ ID NO: 741637 - protein, 410 aa, Homo sapiens
MHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 741638 - protein, 377 aa, Homo sapiens
MHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVWSRLMPSEALGLTDQTTC

SEQ ID NO: 741639 - protein, 257 aa, Homo sapiens
MHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILEIDRGRGERRDPEGRQEMVD

SEQ ID NO: 741640 - protein, 399 aa, Homo sapiens
SDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKSQLTSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETCGEGDGCTALHLACRKGNVVLEQLLTGWTSWPEMPTGTQR

SEQ ID NO: 741641 - protein, 399 aa, Homo sapiens; identical to SEQ ID NO: 741640

SEQ ID NO: 741642 - protein, 154 aa, Homo sapiens
MGGQRELGAEMELDVIGLCSQLEVSFPPSLHTERNLCSLALTAGLWHLVTSILVLALHRGRFFFTLQHCWASLPSHGSVGEICYAVPPSGRLVLRGALLQRRQPSICGELAKIQSDLLRAPQRPSLFGAVSLGSLSECTFYLKYTNTKSQLSWF

SEQ ID NO: 741643 - protein, 1205 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHTESGSDSECSLGLSGGLAFEACSGLTPPKRSRGKPALSRVPFLEGVNGDSDYNGSGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 741644 - protein, 756 aa, Homo sapiens
MSSMPEDDLSRDAEEQRAAKHTSSPMLLSTIPLQLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHTESGSDSECSLGLSGGLAFEACSGLTPPKRSRGKPALSRVPFLEGVNGDSDYNGSGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 741645 - protein, 751 aa, Homo sapiens
MNQVWIGCTGCNLGCPLTLSFTSVCLYSRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHTESGSDSECSLGLSGGLAFEACSGLTPPKRSRGKPALSRVPFLEGVNGDSDYNGSGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 741646 - protein, 1018 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRASVALPPSRRAQRSLFCPCQMYGRQLPPLMVGQGLGFLPTKGKAPVLTNRMVLLAGLLCAKNSHPRSLRGYFTEEPVRSRNSCGAWAQLRRLPRWQEVLGSFLRGCLARSILLPLTTPQGG

SEQ ID NO: 741647 - protein, 106 aa, Homo sapiens
MESPNLLPSALYPLPGFAGPGQVGPQEPEPPVRPTTAQPLTVLAFQQWLPRDKVLPLGVEDTVDKLKMLEGRKTSIRKSVQVAYDRAMIHLSRVRGPHSFVTSSYL

SEQ ID NO: 741648 - protein, 1205 aa, Homo sapiens; identical to SEQ ID NO: 741643

SEQ ID NO: 741649 - protein, 1205 aa, Homo sapiens; identical to SEQ ID NO: 741643

SEQ ID NO: 741650 - protein, 100 aa, Homo sapiens
TRLPSNVSTTAAATLAAAAASAECGACWGHTDPDPSSSSPPWTQDPEPTEGMGKTSRAPQVGGPIPWGQACLGTSLQIPGCPVFWGNWAGNASTKLHCCL

SEQ ID NO: 741651 - protein, 86 aa, Homo sapiens
PFFFSPPGGGAPPFFGGGKPKFGFFPPFPGTCVDPRRRFLGGVCDRLRPRGHEERRTSGTGARSPSRSGPGKARDRAGAVPRVPPR

SEQ ID NO: 741652 - protein, 160 aa, Homo sapiens
MSPPLLLLPLLLLLPLLNVEPAGATLIRIPLRQVHPGRRTLNLLRGWGKPAELPKLGAPSPGDKPASVPLSKFLDAQYFGEIGLGTPPQNFTVAFDTGSSNLWVPSRRCHFFSVPCWFHHRFNPNASSSFKPSGTKFAIQYGTGRVDGILSEDKLTVSGL

SEQ ID NO: 741653 - protein, 103 aa, Homo sapiens
SRGSPLSKLHAGLGSSTHNACSPPPCGCQTKPPATFITKWHALLPGILFPSFTTKSFSAPSFFLASFTKSHWNLDSVSSFASSGPVFWGNWAGNASTKLHCCL

SEQ ID NO: 741654 - protein, 356 aa, Homo sapiens
MSPPLLLLPLLLLLPLLNVEPAGATLIRIPLRQVHPGRRTLNLLRGWGKPAELPKLGAPSPGDKPASVPLSKFLDAQYFGEIGLGTPPQNFTVAFDTGSSNLWVPSRRCHFFSVPCWFHHRFNPNASSSFKPSGTKFAIQYGTGRVDGILSEDKLTIGGIKGASVIFGEALWESSLVFTVSRPDGILGLGFPILSVEGVRPPLDVLVEQGLLDKPVFSFYFNRDPEVADGGELVLGGSDPAHYIPPLTFVPVTVPAYWQIHMERVKVGSRLTLCAQGCAAILDTGTPVIVGPTEEIRALHAAIGGIPLLAGEYIIRCSEIPKLPAVSLLIGGVWFNLTAQDYVIQVGVRHNDATVM

SEQ ID NO: 741655 - protein, 231 aa, Homo sapiens
MSPPLLLLPLLLLLPLLNVEPAGATLIRIPLRQVHPGRRTLNLLRGWGKPAELPKLGAPSPGDKPASVPLSKFLDAQYFGEIGLGTPPQNFTVAFDTGSSNLWVPSRRCHFFSVPCWFHHRFNPNASSSFKPSGTKFAIQYGTGRVDGILSEDKLTIGGIKGASVIFGEALWESSLVFTVSRPDGILGLGFPILSVEGVRPPLDVLVEQGLLDKPVFSFYFNRCWGGCTYL

SEQ ID NO: 741656 - protein, 75 aa, Homo sapiens
IGGIKGASVIFGEALWESSLVFTVSRPDGILGLGFPILSVEGVRPPLDVLVEQGLLDKPVFSFYFNRCWGGCTYL

SEQ ID NO: 741657 - protein, 125 aa, Homo sapiens
MCWLVPIMPSSPLTEPRAERSPSSYRLCYSPSPRLHLPRRCSGRGDSGGLRLSQKVRARGSSRTWRPSLPFRDRVTKALSGQVAAQGPHYWLPAPSPVLLSLHLRLSLSSGGSSRCPCPLVFTPL

SEQ ID NO: 741658 - protein, 655 aa, Homo sapiens
MPEDRNSGGCPAGALASTPFIPKTTYRRIKRCFSFRKGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 741659 - protein, 90 aa, Homo sapiens
MEENNDSTENPQQGQGRQNAIKCGWLRKQGGFVKTWHTRWFVLKGDQLYYFKDEDETKPLEYLTTSGDSWLVHSWGKIPQSSWGRSRGAF

SEQ ID NO: 741660 - protein, 655 aa, Homo sapiens; identical to SEQ ID NO: 741658

SEQ ID NO: 741661 - protein, 653 aa, Homo sapiens
MTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 741662 - protein, 232 aa, Homo sapiens
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYITSTMCT

SEQ ID NO: 741663 - protein, 112 aa, Homo sapiens
MEENNDSTENPQQGQGRQNAIKCGWLRKQGGFVKTWHTRWFVLKGDQLYYFKDEDETKPLGTIFLPGNKVSEHPCNEENPGKFLFEVVPEVYFSIQSASCKEVSSFGEEVLK

SEQ ID NO: 741664 - protein, 748 aa, Homo sapiens
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 741665 - protein, 663 aa, Homo sapiens
MFVQGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 741666 - protein, 709 aa, Homo sapiens
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAGREKK

SEQ ID NO: 741667 - protein, 275 aa, Homo sapiens [sequence omitted]

SEQ ID NO: 741668 - protein, 96 aa, Homo sapiens
SRGLGLNRRGFLKCMWQHSPAPGGNQQGSGGARRPGELSRLRRGPERSLAGVAGWLGESPQLPIAGAALSAAYFLRNPRCGAAQCIEFNTSPCCGK

SEQ ID NO: 741669 - protein, 797 aa, Homo sapiens
MKTRGFSFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHSPVFRHKEMVLKISENTAEGTAFRLERAQDPDEGHNSIQNYTISSNSFFHIKISGSDEGMIYPELVLDKALDREEQEELSLTLTALDGGSPSRSGTSTIRIVVLDVNDNAPQFAQALYETQAPENSPVGSLIVKVSAGDADSGVNAEVSYSFFDASEDILTTFQINPFSGEIFLRELLDYELVNSYKINIQAMDGGGLSARCTVLIKVLDSNDNPPELIISSLSNSVAENSPGIVLAVFKIKDRDSGENGKTICYVQDNLPFFLKPSVDNFYILMTEGALDRESKAEYNITITVTDLGTPRLKTEHSITLQVSDVNDNAPAFTQTSYTLFVRENNSPALHIGSVSATDRDSGTNAQVTYSLLPPQDPHLPLASLVSINADNGHLFALRSLDYEALQAFDFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLLSVLLFVAVRLCRRSRAASVGRCSVPEGPFPGHLVDVSGTGTLFQSYQYEVCLTGGSETGEFKFLKPITPHLPPHRGGKEIEENSTLPNSFGFNY

SEQ ID NO: 741670 - protein, 140 aa, Homo sapiens
MKTRGFSFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAETGEITWAREAEVAVSRDLAL

SEQ ID NO: 741671 - protein, 623 aa, Homo sapiens
METVSEAGTHQEWSFQQIWEKIASDLTRSQDLVINSSQFSKEGDFPCQTEARTICNSHKTEIFPRAIGYKPSFSDVSLFDFHQQLHSGEKSHTCDECGKNFCYISALRIHQRVHMGEKCYKCDVCGKEFSQSSHLQTHQRVHTGEKPFKCVECGKGFSRRSALNVHHKLHTGEKPYNCEECGKAFIHDSQLQEHQRIHTGEKPFKCDICGKSFCGRSRLNRHSMVHTAEKPFRCDTCDKSFRQRSALNSHRMIHTGEKPYKCEECGKGFICRRDLYTHHMVHTGEKPYNCKECGKSFRWASCLLKHQRVHSGEKPIQCEECGKGFYTISQCYSHQRSHSGEKPYKCVECGKGYKRRLDLDFHQRVHTGEKLYNCKECGKSFSRAPCLLKHERLHSGEKPFQCEECGKRFTQNSHLHSHQRVHTGEKPYKCEKCGKGHNSKFNLDMHQKVHTGERPYNCKECGKSFGWASCLLKHQRLHSGEKPFKCEECGKRFTQNSQLHSHQRVHTGEKPYKCDECGKGFSWSSTRLTHQRRHSRETPLKCEQHGKNIVQNSFSEVQEKVHSVEKPYKCEDCGKGYNRRLNLDMHQRVHMGEKTWKCRECDMCFSQASSLRLHQNVHVGEKP

SEQ ID NO: 741672 - protein, 208 aa, Homo sapiens
MASELEPEVQAIDRSLLECSAEEIAGKWLQATDLTREVYQHLAHYVPKIYCRGPNPFPQKEDMLAQHVLLGPMEWYLCGEDPAFGFPKLEQANKPSHLCGRVFKVGEPTYSCRDCAVDPTCVLCMECFLGSIHRDHRYRMTTSGGGGFCDCGDTEAWKEGPYCQKHELNTSEIEEEEDPLVHLSEDVIARTYNIFAITFRYAVEILTW

SEQ ID NO: 741673 - protein, 102 aa, Homo sapiens [sequence omitted]

SEQ ID NO: 741674 - protein, 613 aa, Homo sapiens
RGLRIPTWALQELAGRVTRRGPETGEGRREPGGSASPMRAAFPAGGAGGSVEPPSARPAPQPAGTAARSEEAPARAQAAGMAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYGGDLFSLLLTLRPTVSSGKASLGHFWRVLMKTDCWPRAPAEGRQARLDPFPPSLRSASLPQKPSSGSPPLPPGRFSELEEKIRSNRVIELPLRPLLSRDCRDLLQRLLERDPSRRISFQDFFAHPWVDLEHMPSGESLGRATALVVQAVKKDQEGDSAAALSLYCKALDFFVPALHYEVDAQRKEAIKAKVGQYVSRAEELKAIVSSSNQALLRQGTSARDLLREMARDKPRLLAALEVASAAMAKEEAAGGEQDALDLYQHSLGELLLLLAAEPPGRRRELLHTEVQNLMARAEYLKEQVKMRESRWEADTLDKEGLSESVRSSCTLQ

SEQ ID NO: 741675 - protein, 425 aa, Homo sapiens
RGLRIPTWALQELAGRVTRRGPETGEGRREPGGSASPMRAAFPAGGAGGSVEPPSARPAPQPAGTAARSEEAPARAQAAGMAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYGGDLFSLLLTLRPTVSSGKASLGHFWRVLMKTDCWPRAPAEGRQARLDPFPPSLRSASLPQKPSSGSPPLPPGRSRSWKRRSVATGSSSSPCGPCSPETAGTYCSGSWSGTPAVASPSRTFLRTPGWTWSTCPVGRVWGEQ

SEQ ID NO: 741676 - protein, 613 aa, Homo sapiens; identical to SEQ ID NO: 741674

SEQ ID NO: 741677 - protein, 165 aa, Homo sapiens [sequence omitted]

SEQ ID NO: 741678 - protein, 165 aa, Homo sapiens [sequence omitted]

SEQ ID NO: 741679 - protein, 613 aa, Homo sapiens; identical to SEQ ID NO: 741674

SEQ ID NO: 741680 - protein, 613 aa, Homo sapiens; identical to SEQ ID NO: 741674

SEQ ID NO: 741681 - protein, 167 aa, Homo sapiens
AAPRCPFPARPSPPATAMEVTRPAHTCAQRGWLGDLPGSSCTCPDFLSPVHVCAQGPKSSYHISTPFSLLMRQGQPGPFKGRGLGTRGGVPEAPALLTPPSSTSDFTGGYRLGRSASTSGVRQVVLHTPRPCSQPRDALSQVRLGFSFICEGAGGEGLNMQRKAIKG

SEQ ID NO: 741682 - protein, 464 aa, Homo sapiens
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIDDTSNFDDFPESDILQPVPNTTEPDYKSKDWVFLNYTYKRFEGLTQRGSIPTYMKAGKL

SEQ ID NO: 741683 - protein, 464 aa, Homo sapiens; identical to SEQ ID NO: 741682

SEQ ID NO: 741684 - protein, 412 aa, Homo sapiens
MEEEGLADEEKKLRRSQHARKETEFLRLKRTRLGLDDFESLKVIGRGAFGEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIDDTSNFDDFPESDILQPVPNTTEPDYKSKDWVFLNYTYKRFEGLTQRGSIPTYMKAGKL

SEQ ID NO: 741685 - protein, 425 aa, Homo sapiens
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIAKYHRTGLQIQRLGFSQLYL

SEQ ID NO: 741686 - protein, 464 aa, Homo sapiens; identical to SEQ ID NO: 741682

SEQ ID NO: 741687 - protein, 464 aa, Homo sapiens; identical to SEQ ID NO: 741682

SEQ ID NO: 741688 - protein, 148 aa, Homo sapiens
MEPEAFEICPYDPHHRIPLSRFQYHLASCRRKNPKKAKKMATCKYNACHVVPIKNLEEHEAVCVNRSAVEEEDTENPLKVSPPSSEQNDDTQQVSPCLPSPDIWNVDGANCQHVFVLKTFFPQKVVCENDTKESARETSPQKILRPGQ

SEQ ID NO: 741689 - protein, 123 aa, Homo sapiens
MEPEAFEICPYDPHHRIPLSRFQYHLASCRRKNPKKAKKMATCKYNACHVVPIKNLEEHEAVCVNRSAVEEEDTENPLKVSPPSSEQNDDTQQTFFPQKVVCENDTKESARETSPQKILRPGQ

SEQ ID NO: 741690 - protein, 103 aa, Homo sapiens
MEPEAFEICPYDPHHRIPLSRFQYHLASCRRKNPKKAKKMATCKYNACHVVPIKNLEEHEAVCVNRSAVEEEDTENPLKVVCENDTKESARETSPQKILRPGQ

SEQ ID NO: 741691 - protein, 138 aa, Homo sapiens
RGWAGLLCKPLTCSCLSEPGTAPGRAGKNTARSCKKPFFLFFNHSLPGFASPPLACGNVMNGMYGFQPVRARPGMQGAATSRPTASAPPQRHSLGSQSHSLGSLSHSLGSLSRPGRHEHSGPRGLTSAVGDSDGKHSK

SEQ ID NO: 741692 - protein, 76 aa, Homo sapiens
KVTPQRVSFALFYVCFPVLWCCYTGDVESPQTWKLRPLFLNPEQIETSGLECNGAILAHHNLRLLGSSDLLPQPPQ

SEQ ID NO: 741693 - protein, 76 aa, Homo sapiens; identical to SEQ ID NO: 741692

SEQ ID NO: 741694 - protein, 214 aa, Homo sapiens
HLIRHDVPYLFQKYVKESHGKDIRVVVVGGQVIGSMLRCSTEERMQSNCLFGGVGVKCPLTEQGKQLAIQVSNILGMDFCGIDLLIMDDGSFVVCEANANVGFLAFDQACNLDVGGIIADYTMSLLPNRQTGKMAVLPGLSSPREKNEPDGCASAQGVAESVYTINSGSTSSESEPELGEIRDSSASTMGAPPSMLPEPGYNINNRIASELKLK

SEQ ID NO: 741695 - protein, 258 aa, Homo sapiens [sequence omitted]

SEQ ID NO: 741696 - protein, 120 aa, Homo sapiens
DENRPAQCLQQRRGGESGGDVRSSLKDPEKGEANLSTFVRKDTKFLSNSGFLILLITSIKDGVHITMGCDSPPQHCIVSSFSLRIYFSTISFNLIWGINTFAEGEKENIHYEAFPKLGAW

SEQ ID NO: 741697 - protein, 86 aa, Homo sapiens
CGSPKAGGDIQCCPPGCYHHHLPLGFLLMLLPEEWDEITLRFINSLKEKKSEEHVDDVTDPSITPAGQRQSQWDSVYTTGLERDIF

SEQ ID NO: 741698 - protein, 79 aa, Homo sapiens
AYTCCGVKGQDSTGDTNEEIITFIQERRIILGILQKQGASCVYLSCKVPGILSISDEWSVCIGGMHGRDGQHLLPAECC

SEQ ID NO: 741699 - protein, 192 aa, Homo sapiens
MAPKPGAEWSTALSHLVLGVVSLHAAVSTAEASRGAAAGFLLQVLAATTTLAPGLSTHEDCLAGAWVATVIGLPLLAFDFHWVNGDRSSANLLLGGGMVLAVAGGHLGPEGRSVAGQAMLLVVAVTILIVAVFTANTYGMWGGAMLGVAGLLSRLEEDRLLLLPKEDVCRWALAVGSWAYCRALHTQRLQWE

SEQ ID NO: 741700 - protein, 192 aa, Homo sapiens; identical to SEQ ID NO: 741699

SEQ ID NO: 741701 - protein, 192 aa, Homo sapiens; identical to SEQ ID NO: 741699

SEQ ID NO: 741702 - protein, 110 aa, Homo sapiens
RLGDEAWVSFPTALAPATGGTAEEAGPTAVGGALRRLGPPARRCVGTAQPGNCARLASRESCAVAPPGPGFPGQRLPERREQAEAAAWACSASPLSLPQVCAVASGIRKV

SEQ ID NO: 741703 - protein, 110 aa, Homo sapiens
PGPSPLITLLPNHYAHARTHPNRAFSGPRAPPDPTRSYGLQPAPPRCVQWPQGSGKSRTELLLTSSNGDLEPGRTRVPRVGLQVAGFCAFFLSKVEYLLSVSFGHVWGLV

SEQ ID NO: 741704 - protein, 192 aa, Homo sapiens; identical to SEQ ID NO: 741699

SEQ ID NO: 741705 - protein, 111 aa, Homo sapiens
RLGDEAWVSFPTALAPATGGTAEEAGPTAVGGALRRLGPPARRCVGTAQPGNCARLASRESCAVAPPGPGFPGQRLPERREQAEAAAWACSASPLSLPQARTPTWAPGPQG

SEQ ID NO: 741706 - protein, 192 aa, Homo sapiens; identical to SEQ ID NO: 741699

SEQ ID NO: 741707 - protein, 64 aa, Homo sapiens
MLLVVAVTILIVAVFTANTYGMWGGAMLGVAGLLSRLEEDRLLLYAQRLLALPTSCLPLLSADV

SEQ ID NO: 741708 - protein, 206 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 741709 - protein, 134 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGKKV

SEQ ID NO: 741710 - protein, 97 aa, Homo sapiens
CGRGGSRPGLGTWLVGGGRSPFLRGTISSVVGCYHEVESEHLAAGEEGGPCTLHLGACAQVPRVDEIRGAAAFDSLGAADPGAGVCHAVQLAGRCRQ

SEQ ID NO: 741711 - protein, 149 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAGLFHLALPSADSRLSDLLTEPAEAAKGGHSQGSLGGSMW

SEQ ID NO: 741712 - protein, 119 aa, Homo sapiens
MKSEELQRLTASEPLTLEQEYAMQCSWQEDADKCTFIVLDAEKWQAQPGATEESCMVGDVNLFLTDLEDLTLGEIEVMIAGLFHLALPSADSRLSDLLTEPAEAAKGGHSQGSLGGSMW

SEQ ID NO: 741713 - protein, 206 aa, Homo sapiens; identical to SEQ ID NO: 741708

SEQ ID NO: 741714 - protein, 211 aa, Homo sapiens
MQAATMRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 741715 - protein, 134 aa, Homo sapiens; identical to SEQ ID NO: 741709

SEQ ID NO: 741716 - protein, 139 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGGDPQTDSE

SEQ ID NO: 741717 - protein, 152 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKWLRAVFFRR

SEQ ID NO: 741718 - protein, 121 aa, Homo sapiens
MVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 741719 - protein, 269 aa, Homo sapiens
MRLNQNTLLLGKKVVLVPYTSEHVPSFPFEGSWCPNFVGSVQPPLLRLACHIHPLLEFEECLVSDCSSALTRDRKEIGQIELTRPAVLVYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 741720 - protein, 112 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEW

SEQ ID NO: 741721 - protein, 181 aa, Homo sapiens
CGRGGSRPGLGTWLVGGGRSPFLRGTISSVVGCYHEVESEHLAAGEEGGPCTLHLGACAQVSFPLDMGYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGGDPQTDSE

SEQ ID NO: 741722 - protein, 176 aa, Homo sapiens
CGRGGSRPGLGTWLVGGGRSPFLRGTISSVVGCYHEVESEHLAAGEEGGPCTLHLGACAQVSFPLDMGYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGKKV

SEQ ID NO: 741723 - protein, 206 aa, Homo sapiens; identical to SEQ ID NO: 741708

SEQ ID NO: 741724 - protein, 151 aa, Homo sapiens [sequence omitted]

SEQ ID NO: 741725 - protein, 206 aa, Homo sapiens; identical to SEQ ID NO: 741708

SEQ ID NO: 741726 - protein, 197 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTSECGLAPQPSVRPPLSWSQS

SEQ ID NO: 741727 - protein, 97 aa, Homo sapiens; identical to SEQ ID NO: 741710

SEQ ID NO: 741728 - protein, 448 aa, Homo sapiens
MRENVVVSNMERESGKPVAVVAVVTEPWFTQRYREYLQRQKLFDTQHRVEKMPDGSVALPVLGETLPEQHLQELRNRVAPGSPCMLTQLPDPVPSKRAQGCSPAQKLCLEVSRWVEGRGVKWSAELEADLPRSWQRHGNLLLLSEDCFQAKQWKNLGPELWETVALALGVQRLAKRGRVSPDGTRTPAVTLLLGDHGWVEHVDNGIRYKFDVTQCMFSFGNITEKLRVASLSCAGEVLVDLYAGIGYFTLPFLVHAGAAFVHACEWNPHAVVALRNNLEINGVADRCQIHFGDNRKLKLSNIADRVILGLIPSSEEGWPIACQVLRQDAGGILHIHQNVESFPGKNLQALGVSKVEKEHWLYPQQITTNQWKNGATRDSRGKMLSPATKPEWQRWAESAETRIATLLQQVHGKPWKTQILHIQPVKSYAPHVDHIVLDLECCPCPSVG

SEQ ID NO: 741729 - protein, 448 aa, Homo sapiens; identical to SEQ ID NO: 741728

SEQ ID NO: 741730 - protein, 121 aa, Homo sapiens
LFWLGSCPAPGGLCRPKASSSQAFQAQIMLPRGLHRPSYCLTMASPGPGLAFPQPPEAQPLPHSCFPSPRYSLLPDGLDRPNSSFTLDSLGQAHTSSSLSRSSSCLTLASIGPGAESQWSV

SEQ ID NO: 741731 - protein, 91 aa, Homo sapiens
MGLIKELEHSFPSQPGKFLCCSGFGGSSRPGMAGQQYRQSDRGEVGEQSHRMYLFLWVSGGGRGTEILVFQNGVGKRSVDVEGTGPTRTTS

SEQ ID NO: 741732 - protein, 1164 aa, Homo sapiens
PGGRALQLLPPWSGERDRATANERAAKAGRGARARRRSHPRTRGRAATMLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 741733 - protein, 1164 aa, Homo sapiens; identical to SEQ ID NO: 741732

SEQ ID NO: 741734 - protein, 719 aa, Homo sapiens
PGFQYQEIRELFYQGKNNGTFGALPPLSPLQNLVLWQAHSWFCSWYGDLPWKSRQHCSPGISCPHHSRFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 741735 - protein, 633 aa, Homo sapiens
RRAGGHCSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 741736 - protein, 537 aa, Homo sapiens
PGGRALQLLPPWSGERDRATANERAAKAGRGARARRRSHPRTRGRAATMLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVCILHSCAGTTLGGGQEGGQLNLLPYLLVQEGWGGGGLNRGDSPL

SEQ ID NO: 741737 - protein, 112 aa, Homo sapiens
NQSNVRRMHTAVRLNEVIVKKSRDAKLVLLNMPGPPRNRNGDENCILELKLGERGRWTSGNLGPVPGMEELSCSCLRISTSDRDTGARGPLAAERDPNFVGREGDRVFLLDR

SEQ ID NO: 741738 - protein, 129 aa, Homo sapiens
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTF

SEQ ID NO: 741739 - protein, 254 aa, Homo sapiens
RGGGGGQLCSRRAPASPVSASRGGAGWAARITWRPARRALPAAPARPSPQRAAELRGRRRRPWLASAGAEICCTSWGFVYLFVFSLGFLFFSVILDKMSVRDIKIERGTLVAWELCRSFPRDNFTKMSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVT

SEQ ID NO: 741740 - protein, 146 aa, Homo sapiens
MSSDRQRSDDESPSTSSGSSDADQRDPAAPEPEEQEERKPSATQQKKNTKLSSKTTAKLSTSAKRIQKELAEITLDPPPNCRRMLLFWFQIVENTKRLMYVWICVQQRQLCFFTALQVKQKCRSELDMGVLFSIVYWIDILDLCSD

SEQ ID NO: 741741 - protein, 130 aa, Homo sapiens
MSSDRQRSDDESPSTSSGSSDADQRDPAAPEPEEQEERKPSATQQKKNTKLSSKTTAKLSTSAKRIQKELAEITLDPPPNCRGCPCPLLVTTCANSESLERKISKSCIECKDIQIENEELVLSVSSSLSI

SEQ ID NO: 741742 - protein, 325 aa, Homo sapiens
TFSPAEKFPCGQPSSFVLHPKSTWEWVVEQVAEGVLRCPALPIHTRGSELHSLREAWGYVAGPWILCLLQPFSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 741743 - protein, 566 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPRVKVQGLGDRGPPPDYLQILDPSFLSAACQGIEVRILNQKSRPLQASRRQLRSLGPVAVLLELCSPDMRTGPSVANRGSGTSVSRGALALSPWFHLGPQLHKHLCAWPSLLPWPLQEILQDKDGLNQRYFRKRALYLAHLAHHLAQDPLFGSVCFSYTNGCHLKPSLLLRPRGERHNWAEGIAWDGKSGGEGTEARRPQVWGDRMGSPLAPRAPAESQHSLSLAGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQDLCLDLACPSLQCQAFRWDPAKMWPF

SEQ ID NO: 741744 - protein, 1146 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 741745 - protein, 1198 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGERHTLAEGIAWDGKSGGEGTEARRPQVWGDRMGSPLAPRAPAESQHSLSLAGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 741746 - protein, 1130 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGPGWVYWVPCLHAGCLPCVYTQDPYHHEWLPGPEKCLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 741747 - protein, 1134 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 741748 - protein, 1146 aa, Homo sapiens; identical to SEQ ID NO: 741744

SEQ ID NO: 741749 - protein, 1146 aa, Homo sapiens; identical to SEQ ID NO: 741744

SEQ ID NO: 741750 - protein, 978 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNGAHCGGAGGDPQWLPGSSGTAPRHGHCYPPRPQKLCVDTGWTLSPDPAAACGPGS

SEQ ID NO: 741751 - protein, 1146 aa, Homo sapiens; identical to SEQ ID NO: 741744

SEQ ID NO: 741752 - protein, 1146 aa, Homo sapiens; identical to SEQ ID NO: 741744

SEQ ID NO: 741753 - protein, 191 aa, Homo sapiens
RLVRVWICRPRASILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 741754 - protein, 430 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFPRAKFLDLKAKIPYNEVV

SEQ ID NO: 741755 - protein, 150 aa, Homo sapiens
ELFPCLRHFGLRFYAYNPLAGGLLTGKYKYEDKDGKQPVGRFFGNTWAEMYRNRYWKEHHFEGIALVEKALQAAYGASAPSMTSATLRWMYHHSQLQGAHGDAVILGMSSLEQLEQNLAAAEEGPLEPAVVDAFNQAWHLVAHECPNYFR

SEQ ID NO: 741756 - protein, 201 aa, Homo sapiens
MSGKSLLLKVILLGDGGVGKSSLMNRYVTNKFDSQAFHTIGVEFLNRDLEVDGRFVTLQIWDTAGQERFKSLRTPFYRGADCCLLTFSVDDRQSFENLGNWQKEFIYYADVKDPEHFPFVVLGNKVDKEDRQVTTEEAQTWCMENGDYPYLETSAKDDTNVTVAFEEAVRQVLAVEEQLEHCMLGHTIDLNSGSKAGSSCC

SEQ ID NO: 741757 - protein, 182 aa, Homo sapiens
QADRLALYDFVVEETKKKRSDSQIIENDSDLFVDLAAKINQDNSRKSPKSYLEILAEVRDYKRRRQSYRAKNVHITKKSYTEVIRDVINVHMEELSNHWQEEQEKAEDDAEKNEERRSASVDSRQSGGSYLDAECSRHRRDRSRSPHKRKRNKDKDKNCESRRRKERDGERHHSHKRRKQKI

SEQ ID NO: 741758 - protein, 182 aa, Homo sapiens; identical to SEQ ID NO: 741757

SEQ ID NO: 741759 - protein, 182 aa, Homo sapiens; identical to SEQ ID NO: 741757

SEQ ID NO: 741760 - protein, 195 aa, Homo sapiens
QADRLALYDFVVEETKKKRSDSQIIENDSDLFVDLAAKINQDNSRKSPKSYLEILAEVRDYKRRRQSYRAKNVHITKKSYTEVIRDVINVHMEELSNHWQEEQEKAEDDAEKNEERRSASVDSRQSGGSYLDAECSRHRRDRSRSPHKRKRNKDKDKNCESRRRKESQVWWFAPEIQLLGRLRQESLESGRRRLQ

SEQ ID NO: 741761 - protein, 1256 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGFPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGGSNYENIPSFPGMTP

SEQ ID NO: 741762 - protein, 1463 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGFPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 741763 - protein, 1521 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGFPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYAMIPPNIAACMRNEKLGEACFYLMGHESNYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 741764 - protein, 1160 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGFPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGGSNYENIPSFPGMTP

SEQ ID NO: 741765 - protein, 607 aa, Homo sapiens
MKTNYARFPGPNRNMPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYAMIPPNIAACMRNEKLGEACFYLMGHNQNYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 741766 - protein, 443 aa, Homo sapiens
MSSLGSSFLYALSLFAESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYAMIPPNIAACMRNEKLGEACFYLMGHESNYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 741767 - protein, 1260 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGFPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGAVVGSAVAPGCGLSGLLPS

SEQ ID NO: 741768 - protein, 110 aa, Homo sapiens
MFSLVWGPGEKFRKEREEKRGMKGSALELLLTKRKPKTRWNKKGFACPCQVWKCVSLSVVMETPGSFFANLVGPFFLIIKGSLLTALLNCHWHYPKETNCRNCSYAGAYK

SEQ ID NO: 741769 - protein, 85 aa, Homo sapiens
SSNQPASLTEEKRTPQGSQNSLNTVSSGSGSTSGIGSGGGGGSGVVSTVVQPYDVEIRRGENEGFGFVIVSSVSRPEAGTTFGEC

SEQ ID NO: 741770 - protein, 1521 aa, Homo sapiens; identical to SEQ ID NO: 741763

SEQ ID NO: 741771 - protein, 550 aa, Homo sapiens
MSHGPSPRLAESPQLSKGSLLTILGSPSPERMGPADSLPPTPPSGTPSPGPPPALPLPPAPALLADGDWESREELRLRELEEARARAAQMEKTMRWWSDCTANWREKWSKVRAERNRAREEVRQLRQRLDALTKELAGARRERQEAQGECEARGRELARLRGARGVADQTRDGPEPEAEREPVRDVGSERPPGSQELELVESLLKSMPEESEDCWEARSLGAGGPRGSSGRQERSRLPWEDTAATEEEASKLTALRLRLDESQKVLLKEREDKLALSRNIEKLEGELSQWKIKYEELSKTKQEMLKQLSILKEAHQDELGRMSEDLEDELGARSSMDRKMAELRGEMERLQAENAAEWGRRERLETEKLGLERENKKLRAQVGDLEEALARRRRQTASALDCDLRASQAALFEKNKELADLKHVHGKLKKQFQEKVAELAHANRRVEQHEAEVKKLRLRVEELKKELAQAEDELDEAHNQARKLQRSLDEQTEQSENLQVQLEHLQSRLRRQQQNAPLFGKIRSARFGTEEAEDGTSDLDEDEDLQIQVA

SEQ ID NO: 741772 - protein, 550 aa, Homo sapiens; identical to SEQ ID NO: 741771

SEQ ID NO: 741773 - protein, 550 aa, Homo sapiens; identical to SEQ ID NO: 741771

SEQ ID NO: 741774 - protein, 550 aa, Homo sapiens; identical to SEQ ID NO: 741771

SEQ ID NO: 741775 - protein, 276 aa, Homo sapiens
GTVQLRPPPEGELSQWKIKYEELSKTKQEMLKQLSILKEAHQDELGRMSEDLEDELGARSSMDRKMAELRGEMERLQAENAAEWGRRERLETEKLGLERENKKLRAQVGDLEEALARRRRQTASALDCDLRASQAALFEKNKELADLKHVHGKLKKQFQEKVAELAHANRRVEQHEAEVKKLRLRVEELKKELAQAEDELDEAHNQARKLQRSLDEQTEQSENLQVQLEHLQSRLRRQQQNAPLFGKIRSARFGTEEAEDGTSDLDEDEDLQIQVA

SEQ ID NO: 741776 - protein, 174 aa, Homo sapiens
SGKERHPASLELPDLVGLPGMAPKLILIPSSLPPHPCALEELADLKHVHGKLKKQFQEKVAELAHANRRVEQHEAEVKKLRLRVEELKKELAQAEDELDEAHNQARKLQRSLDEQTEQSENLQVQLEHLQSRLRRQQQNAPLFGKIRSARFGTEEAEDGTSDLDEDEDLQIQVA

SEQ ID NO: 741777 - protein, 120 aa, Homo sapiens
GREESRLWQGLVQSEPRHCISLSGWLAGPWAGWRQQSHLPTPCGKEAYVLYIYIHTRARARAHPEVFGPIWFYKYRTAPRPSPDDLTHPGLHAGLGMLGAVVGAPPWAASLGFAVHHTMQ

SEQ ID NO: 741778 - protein, 141 aa, Homo sapiens
LRLRELEEARARAAQMEKTMRWWSDCTANWREKWSKVRAERNRAREEVRQLRQRLDALTKELAGARRERQEAQGECEARGRELARLRGARGVADQTRDGPEPEAEREPVRDVGSERPPGSQVRGAGGAFALQSRSGRGRLS

SEQ ID NO: 741779 - protein, 72 aa, Homo sapiens
SQWDVSRNDVRNIKNQFFREIICFSFLLLVFDSIFNLSGLQHLPTDPHIMAPTLASSHIFSLSPFGSQGAIA

SEQ ID NO: 741780 - protein, 141 aa, Homo sapiens [sequence omitted]

SEQ ID NO: 741781 - protein, 471 aa, Homo sapiens
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 741782 - protein, 264 aa, Homo sapiens [sequence omitted]

SEQ ID NO: 741783 - protein, 189 aa, Homo sapiens
MAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 741784 - protein, 269 aa, Homo sapiens
VSCVGKTSMEVKMQMFQLHGDEFCPVLDATFVMVARDSENEGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 741785 - protein, 136 aa, Homo sapiens
MYLGLCAHRLVYPDTLLKETKDWQQLWSPRRGNGTAARGMLKCPSVPFSVHTVVWCPKADGCDHVNQLLCESVPLGYSQTFTEERQEQVFFNCTCLTPLIELGPSLSVFCLLLPSPAWFAYFPFSSHLTSSPSSPQ

SEQ ID NO: 741786 - protein, 136 aa, Homo sapiens; identical to SEQ ID NO: 741785

SEQ ID NO: 741787 - protein, 127 aa, Homo sapiens [sequence omitted]

SEQ ID NO: 741788 - protein, 116 aa, Homo sapiens
FFFKTLTVTQAGVQWCDLGSLQSLPPGLKGFSSLSLLSSWDQRCTSPHPANFIFLVEMGFRHVGQTDLELLASSDLLTSASQSAGITGMSHCTWLVLFMLCLRETAQWSAHKGVQT

SEQ ID NO: 741789 - protein, 457 aa, Homo sapiens
MGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTALKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 741790 - protein, 648 aa, Homo sapiens
MTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGMGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKTKPRGLGGDAGTADGRGRTLQRKIMKRSLGRKSTAPPAPRMGRKEGQGNSDSDQPGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 741791 - protein, 103 aa, Homo sapiens
LPPKSQRALAKLFLKKGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 741792 - protein, 477 aa, Homo sapiens
MGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKTKPRGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 741793 - protein, 577 aa, Homo sapiens
MTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGMGSGLDFAETSCAQPVVSTQSDKEPGITASATDTDNANGEEVPHTQEISVSWEGEAAPEIRTSKLGQPDPAPSKKKSNRLTLSKRKKEAQDEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTALKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 741794 - protein, 244 aa, Homo sapiens
MIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTALKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 741795 - protein, 244 aa, Homo sapiens; identical to SEQ ID NO: 741794

SEQ ID NO: 741796 - protein, 273 aa, Homo sapiens
MLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKTKPRGLGGDAGTADGRGRTLQRKIMKRSLGRKSTAPPAPRMGRKEGQGNSDSDQPGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 741797 - protein, 237 aa, Homo sapiens
VSWFPQERVNLFGFWSRFNGSNSNGERKDLQLSGLNSPGSCLEKKEKEEELEKEEGEKTDPILPIRKRVKIQTQKTKPRGLGGDAGTADGRGRTLQRKIMKRSLGRKSTAPPAPRMGRKEGQGNSDSDQPGPKKKFKAPQSKALAASFSEGKEVRTVPKNLGLSACKGACPSSAKEEPRHREPLTQEAGSVPLEDEASSDLDLEQLMEDVGRELGQSGELQHSNSDGEDFPVALFGK

SEQ ID NO: 741798 - protein, 159 aa, Homo sapiens
MTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGMGSGLDFAETSCAQPVVSTQSDKEPGITASATDTDNANG

SEQ ID NO: 741799 - protein, 435 aa, Homo sapiens
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 741800 - protein, 435 aa, Homo sapiens; identical to SEQ ID NO: 741799

SEQ ID NO: 741801 - protein, 297 aa, Homo sapiens
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGLLHAVPGGPDEPSAECLDGNFDPWCRIPVSFV

SEQ ID NO: 741802 - protein, 435 aa, Homo sapiens; identical to SEQ ID NO: 741799

SEQ ID NO: 741803 - protein, 435 aa, Homo sapiens; identical to SEQ ID NO: 741799

SEQ ID NO: 741804 - protein, 207 aa, Homo sapiens
MPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 741805 - protein, 79 aa, Homo sapiens
SGSPSPRSEIMEKKGKSQKEIKSMRTQQAQQEPELTPETCRSGARSPTNQTTEARAGGLAWSHSGHSGRRSVMLLNDGG

SEQ ID NO: 741806 - protein, 101 aa, Homo sapiens
VSREGQRPKSHPSGAPLEWGRRTGNHHKHAPPPSQEKQQLSASLTELHYLQAERVVQEGVWDSFENTFLESTLLTTEHDLVENKHPRVLLWYMFMILMLLV

SEQ ID NO: 741807 - protein, 117 aa, Homo sapiens
ITKEKEADSIVFTAYKYHTGCYSMHALQSVSKTRADITDGNKVPCCPVGTHDFLLCSTAARDVPFPMGKRLGCTYVLKLFNSWKFACSVASAALLSFFFFLREKEHYPNCQVWKEKK

SEQ ID NO: 741808 - protein, 48 aa, Homo sapiens
MLDASLGSALGMCILYGISHRQLPCEHDDKPLPALLGLIPVSIRCIPT

SEQ ID NO: 741809 - protein, 226 aa, Homo sapiens
RGRGRWAQEARPGAPRAGSGAAGAGAGMAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQVPEVRKKFTPNPSAIFQASAPRILNV

SEQ ID NO: 741810 - protein, 188 aa, Homo sapiens
RGGGDAGRRRRGRERRAPGAGRRAPGLAWRGPVSAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQVPEVRKKFTPNPSAIFQASAPRILNV

SEQ ID NO: 741811 - protein, 272 aa, Homo sapiens
RGRGRWAQEARPGAPRAGSGAAGAGAGMAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQVPEVRKKFTPNPSAIFQASAPRILKAVTRAKVLVWSRCTDGLGTPSSASSILLRSLWKAPAFVNCHLAVSQF

SEQ ID NO: 741812 - protein, 204 aa, Homo sapiens
RGRGRWAQEARPGAPRAGSGAAGAGAGMAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRYGLGRDRNESPPCGGRTRRPGSLRSLPSVRALVVRTERRVPCG

SEQ ID NO: 741813 - protein, 226 aa, Homo sapiens; identical to SEQ ID NO: 741809

SEQ ID NO: 741814 - protein, 209 aa, Homo sapiens
RGRGRWAQEARPGAPRAGSGAAGAGAGMAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQASAPRILNV

SEQ ID NO: 741815 - protein, 299 aa, Homo sapiens
RGRGRWAQEARPGAPRAGSGAAGAGAGMAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRYGLGRDRNESPPCGGRTRRPGARGMGWAAERRRLEPGSHATSELPAASEVTPVWSVGTAGGAFAAPCPDSVLEHPRAGSAPLPSQPPSWGQPSEWPAFSRVGTGLPLTPTAGPSRARGARRPCPPALSGHCLVCGRWW

SEQ ID NO: 741816 - protein, 35 aa, Homo sapiens
MVQPCSQLLSWAGSVYNFSGRQCKVLVDLQFWGLE

SEQ ID NO: 741817 - protein, 85 aa, Homo sapiens
PPQPPASSCSCFSSSSSRSEWALDLSTSLCPRTVNCGGEKRNLSSQRAFRWSRTPQRKTHAAPRGADAATLDIAAQLGLPVSRAA

SEQ ID NO: 741818 - protein, 214 aa, Homo sapiens
FPRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGDGQGCGWPSTSWVNVGVVLTYPILISIGDSGSAFLEMQ

SEQ ID NO: 741819 - protein, 124 aa, Homo sapiens
FPRECSRIFGEDGLTLKLFLKRTAPFSILWTLTNYLYLLALKKLTATDVSALFCCNKAFVFLLSWIVLKDRFMGVRVMAYLIQCAMPAFFITPWLQESLSALFRGVAVKLFSLVLSTNRNLKTH

SEQ ID NO: 741820 - protein, 108 aa, Homo sapiens
MAITGIVMMAYADNFHADSIIGVAFAVGSASTSALYKVLFKMFLGSANFGEAAHFVSTLGFFNLIFISFTPVILYFTKVGALVLFCCSAMGLSLWGWAGLWLAFNILG

SEQ ID NO: 741821 - protein, 80 aa, Homo sapiens
ASSQASARADPALGPGPSLSCLSSLAWPSLPADPQEGSKRMQDLLHSSHPGPGSQNRMRQAPEAAVLRKVAGIPADNAPP

SEQ ID NO: 741822 - protein, 37 aa, Homo sapiens
MWLALMSGSSHSTLITPPRLSNPSLFAADVTRSCERP

SEQ ID NO: 741823 - protein, 1033 aa, Homo sapiens
GRDRSRSPGGGPSRCRRPGVAHHPEPTGRRCLLRPQGAPGALKGEAAGTPLLGEEAASPPRMRPEGAGMELGGGEERLPEESRREHWQLLGNLKTTVEGLVSTNSPNVWSKYGGLERLCRDMQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMLCQAKGFICEFCQNEDDIIFPFELHKCRTCEECKACYHKACFKSGSCPRCERLQARREALARQSLESYLSDYEEEPAEALALEAAVLEAT

SEQ ID NO: 741824 - protein, 686 aa, Homo sapiens
HEANNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDGSEGSNLTHISKNGLSVSLASMFSDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMVRKSHCSMQLSPCF

SEQ ID NO: 741825 - protein, 1001 aa, Homo sapiens
GRDRSRSPGGGPSRCRRPGVAHHPEPTGRRCLLRPQGAPGALKGEAAGTPLLGEEAASPPRMRPEGAGMELGGGEERLPEESRREHWQLLGNLKTTVEGLVSTNSPNVWSKYGGLERLCRDMQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMLCQAKGFICEFCQNEDDIIFPFELHKCRTCEECKACYHKACFKSGSCPRCERLQARREALARQSLESYLSDYEEEPAEALALEAAVLEAT

SEQ ID NO: 741826 - protein, 1001 aa, Homo sapiens; identical to SEQ ID NO: 741825

SEQ ID NO: 741827 - protein, 737 aa, Homo sapiens
HEANNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMLCQAKGFICEFCQNEDDIIFPFELHKCRTCEECKACYHKACFKSGSCPRCERLQARREALARQSLESYLSDYEEEPAEALALEAAVLEAT

SEQ ID NO: 741828 - protein, 342 aa, Homo sapiens [sequence omitted]

SEQ ID NO: 741829 - protein, 1001 aa, Homo sapiens; identical to SEQ ID NO: 741825

SEQ ID NO: 741830 - protein, 678 aa, Homo sapiens
GRDRSRSPGGGPSRCRRPGVAHHPEPTGRRCLLRPQGAPGALKGEAAGTPLLGEEAASPPRMRPEGAGMELGGGEERLPEESRREHWQLLGNLKTTVEGLVSTNSPNVWSKYGGLERLCRDMQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSQWSLWMLLFPHFPNFSIRPGAQTSGSSAVRCFYVVLLFFYHARNTHPRVAPFPASEIPAFQARQSGSRLESQHFGRPRRVDHLRPGV

SEQ ID NO: 741831 - protein, 170 aa, Homo sapiens
GVNAKGQQVFLKDIWPTRDEIQAVERQYVIPGMFKEVYQKIETVNESWNALATPSDKLFFWNSKSTYIKSPPFFENLTLDLQPPKSIVDAYVLLNLGDSVTTDHISPAGNIARNSPAARYLTNRGFERQLTQENTDLCLSPPLLTSLSSPLKLWGQLFCHGEQCLGDLEK

SEQ ID NO: 741832 - protein, 314 aa, Homo sapiens
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSGK

SEQ ID NO: 741833 - protein, 314 aa, Homo sapiens; identical to SEQ ID NO: 741832

SEQ ID NO: 741834 - protein, 272 aa, Homo sapiens
MQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSGK

SEQ ID NO: 741835 - protein, 359 aa, Homo sapiens
ASAEDAGRRRKGWPGLPSTHCSSLAAASAAAGCASIWLGLLIPTPSPTARRAAARGRVCSLILRGPARGTPGETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSGK

SEQ ID NO: 741836 - protein, 321 aa, Homo sapiens
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSAAPISLNLK

SEQ ID NO: 741837 - protein, 165 aa, Homo sapiens
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVI

SEQ ID NO: 741838 - protein, 82 aa, Homo sapiens
YFLCMTKASGLAAILSARQWCGFCDQWDKRRKKGKDVKEKLCPVPVLFPWELDRHSQLGLGVLLSNKSNFQDTNITQDHSVT

SEQ ID NO: 741839 - protein, 116 aa, Homo sapiens
AAVPRKAEVPCAAAEGGRREQSPLLHLDLFNFDCPEAEGSRYVLTSPRSLEACARCAVKPVELLPRALADLVREAPGRSMRVATGLYEAYEAERRAKLQQCRAERERIMREEKRRL

SEQ ID NO: 741840 - protein, 93 aa, Homo sapiens
VRPRGCVLEWVRNIVANRLASDGATWADIFKRFNSGTYNNQWMIVDYKAFIPGGPSPGSRVLTILEQIPGMVVVADKTSELYQKTYWASYNIP

SEQ ID NO: 741841 - protein, 108 aa, Homo sapiens
MAALAHEAVGTRDLLAAGCCCLARWGSMEELGLPPRPHLLPACWGPMEEPGLAPRPRPAAGVGSCSLPRSVLEAAVSQTQLGLPQASEKPNCTCGILPQPLGAGSLCT

SEQ ID NO: 741842 - protein, 178 aa, Homo sapiens
SGGGLGRGGSMEPRAGCRLPVRVEQVVNGALVVTVSCGERSFAGILLDCTKKSGLFGLPPLAPLPQVDESPVNDSHGRAPEEGDAEVMQLGSSSHRTRGCWRVQGRGKQGTRLCASPWEMSRMSVFQEKVTCKNGQGNCYKSNSSMHITDCRLTNGSRYPNCAYRTARRRDSIIVACE

SEQ ID NO: 741843 - protein, 600 aa, Homo sapiens
SGGGLGRGGSMEPRAGCRLPVRVEQVVNGALVVTVSCGERSFAGILLDCTKKSGLFGLPPLAPLPQVDESPVNDSHGRAPEEGDAEVMQLGSSSPPPARGVQPPETTRPEPPPPLVPPLPAGSLPPYPPYFEGAPFPHPLWLRDTYKLWVPQPPPRTIKRTRRRLSRNRDPGRLILSTIRLRPRQVLCEKCKSTLSPPEASPGPPAAPRARRRLGSGPDRELRKPEEPENGEPTAAATARRSKRERREEDRAPAEQVPRSPVIKISYSTPQGKGEVVKIPSRVHGSLEPFRPQQAPQDDGSQDPEVLDRESRDRPSCAPSASIPKLKLTRPVPAGADLPPPKIRLKPHRLGDSEHEPVYRAELVGELNGYLRDSSPAPCADGPAGGLADLSSGSSGEDDDFKSCPQGPQGREGLAFLVSCPEGRADCASESACSSDSLDEARSSGSEGTPADTGDLSPGHGASAPSVSREARQTVPPLTVRLHTQSVSECITEDGRTVAVGDIVWGKIHGFPWWPARVLDISLGQKEDGEPSWREAKVSWFGSPTTSFLSISKLSPFSEFFKLRFNRKKKGMYRKAITEAANAARHVAPEIRELLTQFET

SEQ ID NO: 741844 - protein, 509 aa, Homo sapiens
SGGGLGRGGSMEPRAGCRLPVRVEQVVNGALVVTVSCGERSFAGILLDCTKKSGLFGLPPLAPLPQVDESPVNDSHGRAPEEGDAEVMQLGSSSPPPARGVQPPETTRPEPPPPLVPPLPAGSLPPYPPYFEGAPFPHPLWLRDTYKLWVPQPPPRTIKRTRRRLSRNRDPGRLILSTIRLRPRQVLCEKCKSTLSPPEASPGPPAAPRARRRLGSGPDRELRKPEEPENGEPTAAATARRSKRERREEDRAPAEQVPRSPVIKISYSTPQGKGEVVKIPSRVHGSLEPFRPQQAPQDDGSQDPEVLDRESRDRPSCAPSASIPKLKLTRPVPAGADLPPPKIRLKPHRLGDSEHEPVYRAELVGELNGYLRDSSPAPCADGPAGGLADLSSGSSGEDDDFKSCPQGPQGREGLAFLVSCPEGRADCASESACSSDSLDEARSSGSEGTPADTGDLSPGHGASAPSVSREARQTVPPLTVRLHTQSVSECITEDGRTVAVGDIVWGHRR

SEQ ID NO: 741845 - protein, 561 aa, Homo sapiens
VPSHCGFSLSIARSGLFGLPPLAPLPQVDESPVNDSHGRAPEEGDAEVMQLGSSSPPPARGVQPPETTRPEPPPPLVPPLPAGSLPPYPPYFEGAPFPHPLWLRDTYKLWVPQPPPRTIKRTRRRLSRNRDPGRLILSTIRLRPRQVLCEKCKSTLSPPEASPGPPAAPRARRRLGSGPDRELRKPEEPENGEPTAAATARRSKRERREEDRAPAEQVPRSPVIKISYSTPQGKGEVVKIPSRVHGSLEPFRPQQAPQDDGSQDPEVLDRESRDRPSCAPSASIPKLKLTRPVPAGADLPPPKIRLKPHRLGDSEHEPVYRAELVGELNGYLRDSSPAPCADGPAGGLADLSSGSSGEDDDFKSCPQGPQGREGLAFLVSCPEGRADCASESACSSDSLDEARSSGSEGTPADTGDLSPGHGASAPSVSREARQTVPPLTVRLHTQSVSECITEDGRTVAVGDIVWGKIHGFPWWPARVLDISLGQKEDGEPSWREAKVSWFGSPTTSFLSISKLSPFSEFFKLRFNRKKKGMYRKAITEAANAARHVAPEIRELLTQFET

SEQ ID NO: 741846 - protein, 102 aa, Homo sapiens
AFPQLSQKSLIPPHLPLSQEATSPHPTAGPVAHFCLLYLCRWKCLTKPGSHVEPSGKEAWKTWFLAFQGGNYRGVEMDAEFFIVSAMIGGSRARHIFSGVLP

SEQ ID NO: 741847 - protein, 257 aa, Homo sapiens
MAADGVDERSPLLSASHSGNVTPTAPPYLQESSPRAELPPPYTAIASPDASGIPVINCRVCQSLINLDGKLHQHVVKCTVCNEATPIKNPPTGKKYVRCPCNCLLICKDTSRRIGCPRPNCRRIINLGPVMLISEEQPAQPALPIQPEGTRVVCGHCGNTFLWMELRFNTLAKCPHCKKISSVGSALPRRRCCAYITIGMICIFIGVGLTVGTPDFARRFRATYVSWAIAYLLGLICLIRACYWGAIRVSYPEHSFA

SEQ ID NO: 741848 - protein, 257 aa, Homo sapiens; identical to SEQ ID NO: 741847

SEQ ID NO: 741849 - protein, 166 aa, Homo sapiens
MAADGVDERSPLLSASHSGNVTPTAPPYLQESSPRAELPPPYTAIASPDASGIPVINCRVCQSLINLDGKLHQHVVKCTVCNEATPIKNPPTGKKYVRCPCNCLLICKDTSRRIGCPRPNCRRIINLGPVMLISEEQPAQPALPIQPEGTRVVCGHCGNTFLLLSG

SEQ ID NO: 741850 - protein, 257 aa, Homo sapiens; identical to SEQ ID NO: 741847

SEQ ID NO: 741851 - protein, 127 aa, Homo sapiens [sequence omitted]

SEQ ID NO: 741852 - protein, 172 aa, Homo sapiens
PGGGSSSSCSGSSGSRGSSSSHHSAEAATPARPPQAPPLPQSWLLMGWTNARLCCQHPTPEMSLPPPHRTCKKAAPEWMELRFNTLAKCPHCKKISSVGSALPRRRCCAYITIGMICIFIGVGLTVGTPDFARRFRATYVSWAIAYLLGLICLIRACYWGAIRVSYPEHSFA

SEQ ID NO: 741853 - protein, 493 aa, Homo sapiens
MEKYENLGLVGEGSYGMVMKCRNKDTGRIVAIKKFLESDDDKMVKKIAMREIKLLKQLRHENLVNLLEVCKKKKRWYLVFEFVDHTILDDLELFPNGLDYQVVQKYLFQIINGIGFCHSHNIIHRDIKPENILVSQSGVVKLCDFGFARTLAAPGEVYTDYVATRWYRAPELLVGDVKYGKAVDVWAIGCLVTEMFMGEPLFPGDSDIDQLYHIMMCLGNLIPRHQELFNKNPVFAGVRLPEIKEREPLERRYPKLSEVVIDLAKKCLHIDPDKRPFCAELLHHDFFQMDGFAERFSQELQLKVQKDARNVSLSKKSQNRKKEKEKDDSLVEERKTLVVQDTNADPKIKDYKLFKIKGSKIDGEKAEKGNRASNASCLHDSRTSHNKIVPSTSLKDCSNVSVDHTRNPSVAIPPLTHNLSAVAPSINSGMGTETIPIQGYRVDEKTKKCSIPFVKPNRHSPSGIYNINVTTLVSGPPLSDDSGADLPQMEHQH

SEQ ID NO: 741854 - protein, 500 aa, Homo sapiens [sequence omitted]

SEQ ID NO: 741855 - protein, 139 aa, Homo sapiens
FNPGKNFPVGHRNGADSARIETASEVHLCLQQNPPGWWTQEGARRQESPRTWLHSLGPQGFQEGASLQQKSPEGSFRTHTSTAPTPDTADRASSGRRSPKLMSHSLGLLEAIWPADAGEPPWCLSPLWQGQSPQEEERT

SEQ ID NO: 741856 - protein, 114 aa, Homo sapiens
MLPQNKDQVLPQTSVLPGRPTWGFSQLVDSSPHNLQPLSPHQGLPPSQPPFSSTQSRRPSSPPPASPSPGFQFGSCDSNSDFAPHPYSPSLPSSPTFFHQNYLSLPRPRASSPS

SEQ ID NO: 741857 - protein, 97 aa, Homo sapiens
KSLEPYNKKLGTDTWYYAKRCFLSLLENMSKHTIMLRDSVIQECVQFLEHCELHGRNIPAVIEQPLEEERMHVGKNTVTYESRQLKALIYEIIGWNI

SEQ ID NO: 741858 - protein, 104 aa, Homo sapiens
NKSVLNEHQETSKQCEQKIAIENEWKPADIFSTLGERECDRSSLEAKKAQWRKELDEQVALKKKEKEVSEKWNDPWKKSESDKIIWEKHQILDQSRVRHLNCNF

SEQ ID NO: 741859 - protein, 608 aa, Homo sapiens
NKSVLNEHQETSKQCEQKIAIENEWKPADIFSTLGERECDRSSLEAKKAQWRKELDEQVALKKKEKEVSEKWNDPWKKSESDKIIWEKHQILDQSRLFKHSITVIVARLWWSKLMGHSQLRASQTLEETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMNTYMNSTTSKKDTGVQTDDLNIGIFTNAESHCGSLMERDITNCSSPEISAELIGQFSTKKNKQELTQDKGASLEKENNRCNDQCNQFTRIEKQTKHMKKYPKRPDWNINKPPKRYIPASEKYPKQLQKQREEKKVRRQMELLHLVEKNNPGHLSQNRGISPEIFHSSHQETESKLRWHLVKKEEEPLNIHSFSKER

SEQ ID NO: 741860 - protein, 577 aa, Homo sapiens
NKSVLNEHQETSKQCEQKIAIENEWKPADIFSTLGERECDRSSLEAKKAQWRKELDEQVALKKKEKEVSEKWNDPWKKSESDKIIWEKHQILDQSRETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMNTYMNSTTSKKDTGVQTDDLNIGIFTNAESHCGSLMERDITNCSSPEISAELIGQFSTKKNKQELTQDKGASLEKENNRCNDQCNQFTRIEKQTKHMKKYPKRPDWNINKPPKRYIPASEKYPKQLQKQREEKKVRRQMELLHLVEKNNPGHLSQNRGISPEIFHSSHQETESKLRWHLVKKEEEPLNIHSFSKER

SEQ ID NO: 741861 - protein, 287 aa, Homo sapiens [sequence omitted]

SEQ ID NO: 741862 - protein, 414 aa, Homo sapiens
NKSVLNEHQETSKQCEQKIAIENEWKPADIFSTLGERECDRSSLEAKKAQWRKELDEQVALKKKEKEVSEKWNDPWKKSESDKIIWEKHQILDQSRLFKHSITVIVARLWWSKLMGHSQLRASQTLEETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMMT

SEQ ID NO: 741863 - protein, 287 aa, Homo sapiens
NKSVLNEHQETSKQCEQKIAIENEWKPADIFSTLGERECDRSSLEAKKAQWRKELDEQVALKKKEKEVSEKWNDPWKKSESDKIIWEKHQILDQSRLFKHSITVIVARLWWSKLMGHSQLRASQTLEETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQVLHC

SEQ ID NO: 741864 - protein, 463 aa, Homo sapiens
MYGNYSHFMKFPAGYGGSPGHTGSTSMSPSAALSTGKPMDSHPSYTDTPVSAPRTLSAVGTPLNALGSPYRVITSAMGPPSGALAAPPGINLVAPPSSQLNVVNSVSSSEDIKPLPGLPGIGNMNYPSTSPGSLVKHICAICGDRSSGKHYGVYSCEGCKGFFKRTIRKDLIYTCRDNKDCLIDKRQRNRCQYCRYQKCLVMGMKREAVQEERQRSRERAESEAECATSGHEDMPVERILEAELAVEPKTESYGDMNMENSTNDPVTNICHAADKQLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVLFNPDAKGLSNPSEVETLREKVYATLEAYTKQKYPEQPGRFAKLLLRLPALRSIGLKCLEHLFFFKLIGDTPIDTFLMEMLETPLQIT

SEQ ID NO: 741865 - protein, 463 aa, Homo sapiens; identical to SEQ ID NO: 741864

SEQ ID NO: 741866 - protein, 340 aa, Homo sapiens
MNYPSTSPGSLVKHICAICGDRSSGKHYGVYSCEGCKGFFKRTIRKDLIYTCRDNKDCLIDKRQRNRCQYCRYQKCLVMGMKREAVQEERQRSRERAESEAECATSGHEDMPVERILEAELAVEPKTESYGDMNMENSTNDPVTNICHAADKQLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVLFNPDAKGLSNPSEVETLREKVYATLEAYTKQKYPEQPGRFAKLLLRLPALRSIGLKCLEHLFFFKLIGDTPIDTFLMEMLETPLQIT

SEQ ID NO: 741867 - protein, 131 aa, Homo sapiens
MDHHRLFSSSVTMPNSKKSVIQNHLKDYHPSYMLQPNYCPIPPAPEEGSFANSTDQEPTRPQHAGGDVQCSPLLFEKSTDELTGQAKDLEATVREPAASGDVQGPGCSLRRGRWTAWAPALPAGAEPLELR

SEQ ID NO: 741868 - protein, 235 aa, Homo sapiens
MSLGHRASGLQISGRQLCCVNRYSLPALLSRVTVVVIVSMLPEKPWGLGADTEAFFFPFWLCDVQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFCPRRGLPGATPFPHGGMQGGFGGQSRGSRPQRCPLHSPLLSTWNPVSCLVATRLCSVRSYLKLCKNIFF

SEQ ID NO: 741869 - protein, 215 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPFPWSPEK

SEQ ID NO: 741870 - protein, 594 aa, Homo sapiens
MQPQHEFYGFEFVSSMLLPCGVTLSFVSSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFCPRRGLPGATPFPHGGMQGGFGGQSRGSRPQRCPLHSPLLSTWNPVSCLVATRLCSVRSYLKLCKNIFF

SEQ ID NO: 741871 - protein, 409 aa, Homo sapiens
WIELGRLATCYPLLQIRSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFCPRRGLPGATPFPHGGMQGGFGGQSRGSRPQRCPLHSPLLSTWNPVSCLVATRLCSVRSYLKLCKNIFF

SEQ ID NO: 741872 - protein, 526 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFCPRRGLPGATPFPHGGMQGGFGGQSRGSRPQRCPLHSPLLSTWNPVSCLVATRLCSVRSYLKLCKNIFF

SEQ ID NO: 741873 - protein, 333 aa, Homo sapiens
MPRAEFRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFCPRRGLPGATPFPHGGMQGGFGGQSRGSRPQRCPLHSPLLSTWNPVSCLVATRLCSVRSYLKLCKNIFF

SEQ ID NO: 741874 - protein, 526 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESFRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFCPRRGLPGATPFPHGGMQGGFGGQSRGSRPQRCPLHSPLLSTWNPVSCLVATRLCSVRSYLKLCKNIFF

SEQ ID NO: 741875 - protein, 241 aa, Homo sapiens
RILTLLIKKRHSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELATILTLTARTASTTLTTGTAAATPTTRWTGEKVQGQ

SEQ ID NO: 741876 - protein, 129 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENFASIMNVAEPLVFVQGLITVS

SEQ ID NO: 741877 - protein, 95 aa, Homo sapiens
GMGYCGGCCHSGGEGIRKGPCLQATLREAVQAGMGRGAGGLRSQTNVNLFLGAAAFAPGGAFPGPPHSHTVACRAGLEARAGGAGPSDARFTRRY

SEQ ID NO: 741878 - protein, 948 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFCPRRGLPGATPFPHGGMQGGFGGQSRGSRPQRCPLHSPLLSTWNPVSCLVATRLCSVRSYLKLCKNIFF

SEQ ID NO: 741879 - protein, 948 aa, Homo sapiens; identical to SEQ ID NO: 741878

SEQ ID NO: 741880 - protein, 736 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELATILTLTARTASTTLTTGTAAATPTTRWTGEKVQGQ

SEQ ID NO: 741881 - protein, 431 aa, Homo sapiens
TAPGLLLIFDWLFPEITCQAPGNVGERRPSSDHTHTAWASLLRSSWAAPVGPRSLLPAGVYGSADHVVDAQPWSLCDPASYLKSALGPGWGCLGPLLQLYCCASRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFCPRRGLPGATPFPHGGMQGGFGGQSRGSRPQRCPLHSPLLSTWNPVSCLVATRLCSVRSYLKLCKNIFF

SEQ ID NO: 741882 - protein, 863 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGECGHDWPSD

SEQ ID NO: 741883 - protein, 61 aa, Homo sapiens
SHKGDRYIWGGGSLYLCLMSPHRRDDAYWPEAKRAALDERYHSDFNRQDRFHDFDHRDRGR

SEQ ID NO: 741884 - protein, 293 aa, Homo sapiens
MALVSADSRIAELLTELHQLIKQTQEERSRSEHNLVNIQKTHERMQTENKISPYYRTKLRGLYTTAKADAEAECNILRKALDKIAEIKSLLEERRIAAKIAGLYNDSEPPRKTMRRGVLMTLLQQSAMTLPLWIGKPGDKPPPLCGAIPASGDYVARPGDKVAARVKAVDGDEQWILAEVVSYSHATNKYEVDDIDEEGKERHTLSRRRVIPLPQWKANPETDPEALFQKEQLVLALYPQTTCFYRALIHAPPQRPQDDYSVLFEDTSYADGYSPPLNVAQRYVVACKEPKKK

SEQ ID NO: 741885 - protein, 251 aa, Homo sapiens
MALVSADSRIAELLTELHQLIKQTQEERSRSEHNLVNIQKTHERMQTENKISPYYRTKLRGLYTTAKADAEAECKLECNDAISVHCNLCLPGSSDSLASAPNILRKALDKIAEIKSLLEERRIAAKIAGLYNDSEPPRKTMRRGVLMTLLQQSAMTLPLWIGKPGDKPHPLVGGFLASRDYVAELGTVVAGVKGGLGAAGVPGEGEEGMPNSWGDALCKAKETRVGAGYARHRGPERARFQKGLRRSPNAF

SEQ ID NO: 741886 - protein, 105 aa, Homo sapiens
SARDYAHKRKKSVCGSRRAANLRTQVCDHPQTPKKGSRNAPAPLVAVSSPTSLFCPGLGAPVDNGPRVCRFPHCRTSHRAPSADQTNPGRAFAERTQLSEHPEDP

SEQ ID NO: 741887 - protein, 293 aa, Homo sapiens; identical to SEQ ID NO: 741884

SEQ ID NO: 741888 - protein, 316 aa, Homo sapiens
MALVSADSRIAELLTELHQLIKQTQEERSRSEHNLVNIQKTHERMQTENKISPYYRTKLRGLYTTAKADAEAECNILRKALDKIAEIKSLLEERRIAAKIAGLYNDSEPPRKTMRRGVLMTLLQQSAMTLPLWIGKPGDKEGSSCEGGAGAQGLGLTLCSTHRPPPLCGAIPASGDYVARPGDKVAARVKAVDGDEQWILAEVVSYSHATNKYEVDDIDEEGKERHTLSRRRVIPLPQWKANPETDPEALFQKEQLVLALYPQTTCFYRALIHAPPQRPQDDYSVLFEDTSYADGYSPPLNVAQRYVVACKEPKKK

SEQ ID NO: 741889 - protein, 258 aa, Homo sapiens
MALVSADSRIAELLTELHQLIKQTQEERSRSEHNLVNIQKTHERMQTENKISPYYRTKLRGLYTTAKADAEAECNILRKALDKIAEIKSLLEERRIAAKIAGLYNDSEPPRKTMRRGVLMTLLQQSAMTLPLWIGKPGDKPPPLCGAIPASGDYVARPGDKVAARVKAVDGDEQWILAEVVSYSHATNNEALFQKEQLVLALYPQTTCFYRALIHAPPQRPQDDYSVLFEDTSYADGYSPPLNVAQRYVVACKEPKKK

SEQ ID NO: 741890 - protein, 103 aa, Homo sapiens
SARDYAHKRKKSVCGSRRAANLRTQVCDHPQTPKKGSRNAPAPLVAVSSPTSLFCPGLGAPVDNGPRVCRFPHCRTSHRAPSADQTNPGKKSPPSIPRWEHGL

SEQ ID NO: 741891 - protein, 123 aa, Homo sapiens
MGENAENAQALWLVKLGFRQEPERCAKMKTTFPTGQRVTSQRNDYACVQGPPRATTLIKGKKACAVLDVPPIFERRSVIIRRLRKRVRGTRLLPSSQFPARRACFVPDSVGGDGPWPETSGET

SEQ ID NO: 741892 - protein, 147 aa, Homo sapiens
ASLKSLVQEWRWGYGHLAVPTASLDCVAWRWGLSFRVTEAPLGSRPPGAPDLPDSTHPFPLPARHSHQGRPGARIAGRGQATACLPPPSRLACPLACLHAGFQQSQLLQSQVDPVSVLPRCVTLGESTSLSFCFPLYENGTDVTGLL

SEQ ID NO: 741893 - protein, 753 aa, Homo sapiens
VTEKMDVLGTVGSCGAPNFRQVQGGLTVFGMGQPSLSGFRRVLQKLQKDGHRECVIFCVREEPVLFLRADEDFVSYTPRDKQNLHENLQGLGPGVRVESLELAIRKEIHDFAQLSENTYHVYHNTEDLWGEPHAVAIHGEDDLHVTEEVYKRPLFLQPTYRYHRLPLPEQGSPLEAQLDAFVSVLRETPSLLQLRDAHGPPPALVFSCQMGVGRTNLGMVLGTLILLHRSGTTSQPEAAPTQAKPLPMEQFQVIQSFLRMVPQGRRMVEEVVDRAITACAELHDLKEVVLENQKKLEGIRPESPAQGSGSRHSVWQRALWSLERYFYLILFNYYLHEQYPLAFALSFSRWLCAHPELYRLPVTLSSAGPVAPRDLIARGSLREDDLVSPDALSTVREMDVANFRRVPRMPIYGTAQPSAKALGSILAYLTDAKRRLRKVVWVSLREEAVLECDGHTYSLRWPGPPVAPDQLETLEAQLKAHLSEPPPGKEGPLTYRFQTCLTMQEVFSQHRRACPGLTYHRIPMPDFCAPREEDFDQLLEALRAALSKDPGTGFVFSCLSGQGRTTTAMVVAVLAFWHIQGFPEVGEEELVSVPDAKFTKGEFQVVMKVVQLLPDGHRVKKEVDAALDTVSETMTPMHYHLREIIICTYRQAKAAKEAQEMRRLQLRSLQYLERYVCLILFNAYLHLEKADSWQRPFSTWMQEVASKAGIYEILNELGFPELESGEDQPFSRLRYRWQEQSCSLEPSAPEDLL

SEQ ID NO: 741894 - protein, 223 aa, Homo sapiens
MGVMVSLTVSSARRPPPCITRSASGSSCLSGQGRTTTAMVVAVLAFWHIQGFPEVGEEELVSVPDAKFTKGEFQVVMKVVQLLPDGHRVKKEVDAALDTVSETMTPMHYHLREIIICTYRQAKAAKEAQEMRRLQLRSLQYLERYVCLILFNAYLHLEKADSWQRPFSTWMQEVASKAGIYEILNELGFPELESGEDQPFSRLRYRWQEQSCSLEPSAPEDLL

SEQ ID NO: 741895 - protein, 652 aa, Homo sapiens
VTEKMDVLGTVGSCGAPNFRQVQGGLTVFGMGQPSLSGFRRVLQKLQKDGHRECVIFCVREEPVLFLRADEDFVSYTPRDKQNLHENLQGLGPGVRVESLELAIRKEIHDFAQLSENTYHVYHNTEDLWGEPHAVAIHGEDDLHVTEEVYKRPLFLQPTYRYHRLPLPEQGSPLEAQLDAFVSVLRETPSLLQLRDAHGPPPALVFSCQMGVGRTNLGMVLGTLILLHRSGTTSQPEAAPTQAKPLPMEQFQVIQSFLRMVPQGRRMVEEVVDRAITACAELHDLKEVVLENQKKLEGIRPESPAQGSGSRHSVWQRALWSLERYFYLILFNYYLHEQYPLAFALSFSRWLCAHPELYRLPVTLSSAGPVAPRDLIARGSLREDDLVSPDALSTVREMDVANFRRVPRMPIYGTAQPSAKALGSILAYLTDAKRRLRKVVWVSLREEAVLECDGHTYSLRWPGPPVAPDQLETLEAQLKAHLSEPPPGKEGPLTYRFQTCLTMQEVFSQHRRACPGLTYHRIPMPDFCAPREEVRVLLRLRPLGRDRRPPCLPSGLGSGRMKRPQLLYGAREWSHEVFRFGPSGLFTFLPSFVCVYVCLLCVIGYMCVYCYRCVCIGVCILLRMCICVIRCVYMCLLCCRVYVCVLCYGCVL

SEQ ID NO: 741896 - protein, 390 aa, Homo sapiens
VTEKMDVLGTVGSCGAPNFRQVQGGLTVFGMGQPSLSGFRRVLQKLQKDGHRECVIFCVREEPVLFLRADEDFVSYTPRDKQNLHENLQGLGPGVRVESLELAIRKEIHDFAQLSENTYHVYHNTEDLWGEPHAVAIHGEDDLHVTEEVYKRPLFLQPTYRYHRLPLPEQGSPLEAQLDAFVSVLRETPSLLQLRDAHGPPPALVFSCQMGVGRTNLGMVLGTLILLHRSGTTSQPEAAPTQAKPLPMEQFQVIQSFLRMVPQGRRMVEEVIDLLCERQLHPVFWTLMPPSPTWETSGMTTYPAWWGWQDGGGFSRSWRLQGAPLMGRKELPGGERSTEEEACSTCLGTWAGGTEEAKAWSCRSPGISLCPGSPGWPGAPTCCSRSPKEC

SEQ ID NO: 741897 - protein, 92 aa, Homo sapiens
MRKLTLREVNRSQGANLFRSPSSQATDSSSELSGLSGTLTSPETLLLPLLSSQVASKAGIYEILNELGFPELESGEDQPFSRLRYRWQEQSC

SEQ ID NO: 741898 - protein, 634 aa, Homo sapiens
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 741899 - protein, 130 aa, Homo sapiens
PVNCNAVGLFTTSLNLSSSAFLLPPVPALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 741900 - protein, 634 aa, Homo sapiens; identical to SEQ ID NO: 741898

SEQ ID NO: 741901 - protein, 634 aa, Homo sapiens; identical to SEQ ID NO: 741898

SEQ ID NO: 741902 - protein, 634 aa, Homo sapiens; identical to SEQ ID NO: 741898

SEQ ID NO: 741903 - protein, 634 aa, Homo sapiens; identical to SEQ ID NO: 741898

SEQ ID NO: 741904 - protein, 634 aa, Homo sapiens; identical to SEQ ID NO: 741898

SEQ ID NO: 741905 - protein, 634 aa, Homo sapiens; identical to SEQ ID NO: 741898

SEQ ID NO: 741906 - protein, 634 aa, Homo sapiens
MKIVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 741907 - protein, 503 aa, Homo sapiens
MVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 741908 - protein, 639 aa, Homo sapiens
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDEALNLEE

SEQ ID NO: 741909 - protein, 32 aa, Homo sapiens
MRVNRDDSGKRGWHTAQTVPKPGLGLPKRPPV

SEQ ID NO: 741910 - protein, 873 aa, Homo sapiens
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVREALHVAGVEMQLTAAMSFLTILQDESVSIHAYTHSFLQVILLHLEHRDTGVSNAWLETLLSVIEVLPKETLRHEILNPLVSKAQLSQTVQSRLVSCKILGKLTNKFDAHTIKREILPLVKSLCQDVEYEVRSCMCRQLENIAQGIGTELTKSVVLPELIELSRDEGSSVRLAAFETLVNLLDIFDTDDRSQTILPLVKSFCEKSFKADESILISLSFHLGKLCHGLYGIFTPDQHLRFLEFYKKLCTLGLQQENGHNENQIPPQILEQEKKYISVRKNCAYNFPAMIVFVDPKNFHMELYSTFFCLCHDPEVPVRYTIAICFYEVSKLLNSGVYLIHKELITLLQDESLEVLDALIDHLPEILELMSTGGESSVQENKLSSLPDLIPALTAAEQRAAASLKWRTHEKLLQKYACLPHVISSDQIYYRFLQRMFTIMMTNNVLPVQKAASRTLCIFLRYNRKQEQRHEVIQKLIEQLGQGKSYWNRLRFLDTCEFIIEIFSKSFFCKYFFLPAIELTHDPVANVRMKLCYLLPKVKSTLKIPADKHLLQQLEMCVRKLLCQEKDKDVLAIVKRTVLELDRMEMSMDAFQKKFYEKDLLDQEKEREELLLLEMEQLEKEKQQNDGRPMSDKMFEKKRRDTKTPTQSLPKNIPISVPGPSSVTPSTSKEIKKSKLIRSQSFNNQAFHAKYGNLEKCASKSSTTGYTTSVSGLGKTSVLSLADDSFRTRNASSVPSSFSPNTPLPSTSRGTGNSVDPKSSGSKDTQPRKATLKSRKSNP

SEQ ID NO: 741911 - protein, 121 aa, Homo sapiens
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVRQVHEDAHLFIQRVWISHMFVQRV

SEQ ID NO: 741912 - protein, 905 aa, Homo sapiens
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVRQSMRMHTYLSREYGSHICLSRGCDSVEENTYWKPCMLQELEMQLTAAMSFLTILQDESVSIHAYTHSFLQVILLHLEHRDTGVSNAWLETLLSVIEVLPKETLRHEILNPLVSKAQLSQTVQSRLVSCKILGKLTNKFDAHTIKREILPLVKSLCQDVEYEVRSCMCRQLENIAQGIGTELTKSVVLPELIELSRDEGSSVRLAAFETLVNLLDIFDTDDRSQTILPLVKSFCEKSFKADESILISLSFHLGKLCHGLYGIFTPDQHLRFLEFYKKLCTLGLQQENGHNENQIPPQILEQEKKYISVRKNCAYNFPAMIVFVDPKNFHMELYSTFFCLCHDPEVPVRYTIAICFYEVSKLLNSGVYLIHKELITLLQDESLEVLDALIDHLPEILELMSTGGESSVQENKLSSLPDLIPALTAAEQRAAASLKWRTHEKLLQKYACLPHVISSDQIYYRFLQRMFTIMMTNNVLPVQKAASRTLCIFLRYNRKQEQRHEVIQKLIEQLGQGKSYWNRLRFLDTCEFIIEIFSKSFFCKYFFLPAIELTHDPVANVRMKLCYLLPKVKSTLKIPADKHLLQQLEMCVRKLLCQEKDKDVLAIVKRTVLELDRMEMSMDAFQKKFYEKDLLDQEKEREELLLLEMEQLEKEKQQNDGRPMSDKMFEKKRRDTKTPTQSLPKNIPISVPGPSSVTPSTSKEIKKSKLIRSQSFNNQAFHAKYGNLEKCASKSSTTGYTTSVSGLGKTSVLSLADDSFRTRNASSVPSSFSPNTPLPSTSRGTGNSVDPKSSGSKDTQPRKATLKSRKSNP

SEQ ID NO: 741913 - protein, 411 aa, Homo sapiens
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVREALHVAGVEMQLTAAMSFLTILQDESVSIHAYTHSFLQVILLHLEHRDTGVSNAWLETLLSVIEVLPKETLRHEILNPLVSKAQLSQTVQSRLVSCKILGKLTNKFDAHTIKREILPLVKSLCQDVEYEVRSCMCRQLENIAQGIGTELTKSVVLPELIELSRDEGSSVRLAAFETLVNLLDIFDTDDRSQTILPLVKSFCEKSFKADESILISLSFHLGKLCHGLYGIFTPDQHLRFLEFYKKLCTLGLQQENGHNENQIPPQILEQEKKYISVRKNCAYNFPVINMYLYLLRIFIITLKYVHRWHSKYCHF

SEQ ID NO: 741914 - protein, 135 aa, Homo sapiens
AGRGPGGEKRLCAAGADRGEVPLSASGVWACAAVLAHTCRYSPSVSPLASMGRWWPPPPRLWMSLGLGFRALRPREDLPPSLLLFQVSAWRVCGLHRGTPRGPLLFSRLDCVHVSNISQPLLPTSGLGLHRVSLL

SEQ ID NO: 741915 - protein, 102 aa, Homo sapiens
SGGTDSGDPRRRVPRVPRPERGPGLDCWHVYSSKYTEIKCKDKPSKKITLKSGHDIQSDCLKELKRGHKWIASAVACWLGEQKMRSQISKSFSPRLLARGCM

SEQ ID NO: 741916 - protein, 190 aa, Homo sapiens
LLRLRPTWKALQHPAWPEEKNKQILVLGLDGAGKTSVLHSLASNRVQHSVAPTQGFHAVCINTEDSQMEFLEIGGSKPFRSYWEMYLSKGLLLIFVVDSADHSRLPEAKKYLHQLIAANPVLPLVVFANKQDLEAAYHITDIHEALALSEVGNDRKMFLFGTYLTKNGSEIPSTMQDAKDLIAQLAADVQ

SEQ ID NO: 741917 - protein, 216 aa, Homo sapiens
RPPPLQIMTKQGKETNKEKEQFKGQEEKGENKDSTLTRTPLEPLEKNKQILVLGLDGAGKTSVLHSLASNRVQHSVAPTQGFHAVCINTEDSQMEFLEIGGSKPFRSYWEMYLSKGLLLIFVVDSADHSRLPEAKKYLHQLIAANPVLPLVVFANKQDLEAAYHITDIHEALALSEVGNDRKMFLFGTYLTKNGSEIPSTMQDAKDLIAQLAADVQ

SEQ ID NO: 741918 - protein, 34 aa, Homo sapiens
MPDSGLSFCSLTLRNSFVLYGSSLTVSRPPTVII

SEQ ID NO: 741919 - protein, 103 aa, Homo sapiens
RLEGRIRSWARGRPLVGRVRPRRRPRLTLLRRRQVRHQPDSIILYGQSIGTVPTVDLASRYECAAVVLHSPLTSGMRVAFPDTKTYCFDAFPNIEKVSKITSP

SEQ ID NO: 741920 - protein, 307 aa, Homo sapiens
AFSPDGKALAVGLNDGSFLVVNADTVEDMVSFHHRKEMISDIKFSKDTGKYLAVASHDNFVDIYNVLTSKRVGICKGASSYITHIDWDSRGKLLQVNSGAREQLFFEAPRGKRHIIRPSEIEKIEWDTWTCVLGPTCEGIWPAHSDITDVNAASLTKDCSLLATGDDFGFVKLFSYPVKGQHARFKKYVGHSAHVTNVRWLHNDSVLLTVGGADTALMIWTREFVGTQESKLVDSEESDTDVEEDGGYDSDVAREKAIDYTTKIYAVSIREMEGTKPHQQLKEVSVEERPPVSRAAPQPEKLQKNNI

SEQ ID NO: 741921 - protein, 108 aa, Homo sapiens
ALKFMVELAGRGSGRTGESSELFAPSFCFFSTGMGWNWSLSPNPKANSIMWLLTVPHSPVDASQKKTPPAFPESPAAVPPTTTGGPQTQLCIYTASHHSHSTGAQQAH

SEQ ID NO: 741922 - protein, 47 aa, Homo sapiens
SSKMYKHEKAKGVTRGHTCFSGSQELEKISSLVPFLNPLYPTPNLFP

SEQ ID NO: 741923 - protein, 266 aa, Homo sapiens
GTSSSAAATQRLADYSPPSPALSFAHNGNNNNNGNGYTYTAGGEASVPSPDGCPELQPTFDPAPAPPPGAPLIWAQFERSPGGGPAAPVSSSCSSSASSSASSSSVVFPGGGASAPSNANLGLLVHRRLHPGTSCPRLSPPLHMAPGAGEHHLARRVRSDPGGGGLAYAAYANGLGAQLPGLQPSDTSGSSSSSSSSSSSSSSSSGLRRKGSRDCSVCFESEVIAALVPCGHNLFCMECANRICEKSEPECPVCHTAVTQAIRIFS

SEQ ID NO: 741924 - protein, 266 aa, Homo sapiens; identical to SEQ ID NO: 741923

SEQ ID NO: 741925 - protein, 86 aa, Homo sapiens
RVPQDPLTFQYQKSNVASEARPSKDVTIQPPTRTGEQRVWRDEVTHQGHAVLQSQDPNPGSPQSRPSPPTPWRYVHFTQIPNRLRV

SEQ ID NO: 741926 - protein, 269 aa, Homo sapiens
MNIHMKRKTIKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQE

SEQ ID NO: 741927 - protein, 319 aa, Homo sapiens
MNIHMKRKTIKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKTAYPQM

SEQ ID NO: 741928 - protein, 301 aa, Homo sapiens
MNIHMKRKTIKNINTFENRMLMLDGMPAVRVDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKTAYPQM

SEQ ID NO: 741929 - protein, 269 aa, Homo sapiens
MEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKTAYPQM

SEQ ID NO: 741930 - protein, 131 aa, Homo sapiens
MGGSALNQGVLEGDDAPGQSLYERLSQRMLDISGDRGVLKDVIREGAGDLVAPDASVLDASSWVNSSTPKAPASIFTSEPPEPPPPASPSSSLTTPPWTCSSAPPGASELPLPGPQNYPYGFSCVTFCLPS

SEQ ID NO: 741931 - protein, 163 aa, Homo sapiens [sequence omitted]

SEQ ID NO: 741932 - protein, 292 aa, Homo sapiens
MLCVLVRCPIISRSLSLRTQPPAPVSAPSCSLSLQLDAPSCPASSNYVPHLTPHVRAPSCPARSGYMPRLALPHMPHHAQRAPITCRHLAPLQVPNVPCVVPLRVPSCFVRSDYGPHLATHRATSVVPELARARAVGGGWNETMSASSWPQNGMPPSSLYERLSQRMLDISGDRGVLKDVIREGAGDLVAPDASVLDITLWGMELGLLSMQRGELARFLFKPNYAYGTLGSPPLIPPNTTVLFKIELLDFLDCAESDKFCALSAVRCRAQMSALYRETNGLVFLVILLDGLP

SEQ ID NO: 741933 - protein, 125 aa, Homo sapiens
MGGSALNQGVLEGDDAPGQSLYERLSQRMLDISGDRGVLKDVIREGAGDLVAPDASVLDITLWGMELGLLSMQRGELARDHVARLVSNFSAQAILPPWLLKCQDYRSEPPHPATAGILIGIVLNL

SEQ ID NO: 741934 - protein, 302 aa, Homo sapiens
PCLPFSWAPVSSFPLAFWSYPSVQSTGLSNTSLPSPVVALAASFTYSSNRFTTNLLFCVFIYRILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 741935 - protein, 177 aa, Homo sapiens
MSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 741936 - protein, 290 aa, Homo sapiens
LDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKL

SEQ ID NO: 741937 - protein, 151 aa, Homo sapiens
YLDMGTTHITLTTLKNILTMTVELEELILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKL

SEQ ID NO: 741938 - protein, 81 aa, Homo sapiens
YYYLLTFIQPRVPKPHPSAQSSLASKMAAGLASQSPEGHEAFLGQECRGSGFAAPGREGRLRQVEIMPLPSILDNRVRPCL

SEQ ID NO: 741939 - protein, 426 aa, Homo sapiens
MLPSASRERPGYRAGVAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 741940 - protein, 426 aa, Homo sapiens; identical to SEQ ID NO: 741939

SEQ ID NO: 741941 - protein, 426 aa, Homo sapiens; identical to SEQ ID NO: 741939

SEQ ID NO: 741942 - protein, 426 aa, Homo sapiens; identical to SEQ ID NO: 741939

SEQ ID NO: 741943 - protein, 299 aa, Homo sapiens [sequence omitted]

SEQ ID NO: 741944 - protein, 656 aa, Homo sapiens
AEIQEQLKGETDVETQSNEPLREEDGTDIQSLGRREVKGEDDKDTQELGRKNQGQLGNEFSGKIHIPKGKNQEHIRGEDGAHTQISESGNWGKLTSQIDGEMHSAEWKKDQQIGGENGAEIQIQGKRNLREVGGEDGVKTWAPGKETQSQFRSDLGRKILLSEWKSQKQMGSENGTEIQAPVERNQREPGGEDGVKTQRPKRENEDQLDSEIGGSHSPGRRNWELIGKDVAENQASEKRNQREVGNEDGRMIWRLRGKNWRLRAKKQTVKSKDNGKTRLSEWKRNLRGTTADDGTETQAPAGDDQGQLRVEIDEEIQVQGQGNKNDGGVEDVAELQDIGSQRKCTDEDVGEPRAPRGGNKDLVRGEDAVRDSLQVDCSGSERPTGRKHSLPWPPAFTGYGCGTREQEQAVAVNGFISAPCPEMNPVPHWGEVFLLVGGEGEHLASQGTTPARDHRVGISPASQQAQPESWRRRQRDKGVDPEKAPSLTRQSQNPPSLTAPLGMPSACSCLPCGPAPEAAIILAGPPTALTVLPKGTGLKKSKRLLLESLMRRRIAHLKWGLPRRILESYFLFNFLGSCSLTLAGARLSGLNTGQELQAQQERYCEAQGSPPGLKSPERFQRVQRPDRKSSKLPIQARALERNRPHMSEPIKHFHPA

SEQ ID NO: 741945 - protein, 656 aa, Homo sapiens; identical to SEQ ID NO: 741944

SEQ ID NO: 741946 - protein, 271 aa, Homo sapiens
AEIQEQLKGETDVETQSNEPLREEDGTDIQSLGRREVKGEDDKDTQELGRKNQGQLGNEFSGKIHIPKGKNQEHIRGEDGAHTQISESGNWGKLTSQIDGEMHSAEWKKDQQIGGENGAEIQIQGKRNLREVGGEDGVKTWAPGKETQSQFRSDLGRKILLSEWKSQKQMGSENGTEIQAPVERNQREPGGEDGVKTQRPKRENEDQLDSEIGGSHSPGRRNWELIGKDVAENQASEKRNQREVGNEDGRMIWRLRGKNWRLRAKKQTVKK

SEQ ID NO: 741947 - protein, 183 aa, Homo sapiens
MEGDAETNVLECANQRLVISETDGEILTPGWDTQDRMGVESRTNIQELGNRNQREAGGENLPETQAHMGENQEQLRCKIDAELAKRKHLAPNLSLREPDSTLPPKVGDPRAGEDSIGDHTASQRDLQLQGHCCTGATLPKTESPQGQEAPGNPNGAPQNTRASKKFSIMKHLNFFLFQNGFKK

SEQ ID NO: 741948 - protein, 656 aa, Homo sapiens; identical to SEQ ID NO: 741944

SEQ ID NO: 741949 - protein, 278 aa, Homo sapiens
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGLMEVLPERCVQIAKRELLFLGPVGLIMYLGGVFFINRQRSSTAMTVMADLGERMVRENLKVWIYPEGTRNDNGDLLPFKKGAFYLAVQAQVPIVPVVYSSFSSFYNTKKKFFTSGTVTVQVLEAIPTSGLTAADVPALVDTCHRAMRTTFLHISKTPQENGATAGSGVQPAQ

SEQ ID NO: 741950 - protein, 278 aa, Homo sapiens; identical to SEQ ID NO: 741949

SEQ ID NO: 741951 - protein, 278 aa, Homo sapiens; identical to SEQ ID NO: 741949

SEQ ID NO: 741952 - protein, 246 aa, Homo sapiens
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGLMEVLPERCVQIAKRELLFLGPVGLIMYLGGVFFINRQRSSTAMTVMADLGERMVRENVPIVPVVYSSFSSFYNTKKKFFTSGTVTVQVLEAIPTSGLTAADVPALVDTCHRAMRTTFLHISKTPQENGATAGSGVQPAQ

SEQ ID NO: 741953 - protein, 168 aa, Homo sapiens
MTSRVVLYIFGKFFPKFCLRHCRLPGVKDIKDPLFPLKYRLVMNFLVRIVTVSFMMAIFLKMRLAAVARWWAEPQGPRWPRSRWEDPEARRTLSEPSAQPPGTHQGAAGLQGPAHKLHQGLWERRGLEGQESQTHAPWATGSRESGPAAPAGLEDSVGSALYSVAVFL

SEQ ID NO: 741954 - protein, 278 aa, Homo sapiens; identical to SEQ ID NO: 741949

SEQ ID NO: 741955 - protein, 278 aa, Homo sapiens; identical to SEQ ID NO: 741949

SEQ ID NO: 741956 - protein, 278 aa, Homo sapiens; identical to SEQ ID NO: 741949

SEQ ID NO: 741957 - protein, 278 aa, Homo sapiens; identical to SEQ ID NO: 741949

SEQ ID NO: 741958 - protein, 278 aa, Homo sapiens; identical to SEQ ID NO: 741949

SEQ ID NO: 741959 - protein, 278 aa, Homo sapiens; identical to SEQ ID NO: 741949

SEQ ID NO: 741960 - protein, 374 aa, Homo sapiens
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGRPGLGGGFWGLSGAELSWGCVGLGPGDEDTGLPVPGRARPQYLPQGQTQRLGGHTTRPGSQGEGRVPGRPVGAQQLLFQRTLSPPLSLSLSLCLPGLMEVLPERCVQIAKRELLFLGPVGLIMYLGGVFFINRQRSSTAMTVMADLGERMVRENLKVWIYPEGTRNDNGDLLPFKKGAFYLAVQAQVPIVPVVYSSFSSFYNTKKKFFTSGTVTVQVLEAIPTSGLTAADVPALVDTCHRAMRTTFLHISKTPQENGATAGSGVQPAQ

SEQ ID NO: 741961 - protein, 181 aa, Homo sapiens
PPSPAALAIRGLSARGRSGSGSGSELAAPSGAGPGHGAVAVSGRGAAVAAAAGAAEPRGRVLRQGRPVLRAVLHGVRRGLARLPAAPRRPDGGEHEHHRLVRAKLQVLLRAPLRGAGPAQAAGGPSLCHRLQPPEHPGHDGPHGGPSGALRADRQAGAALPGARGPHHVPRGRLLHQPAAL

SEQ ID NO: 741962 - protein, 181 aa, Homo sapiens; identical to SEQ ID NO: 741961

SEQ ID NO: 741963 - protein, 315 aa, Homo sapiens
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGLMEVLPERCVQIAKRELLFLGPVGLIMYLGGVFFINRQRSSTAMTVMADLGERMVRENLKVWIYPEGTRNDNGDLLPFKKGAFYLAVQAQVPIVPVVYSSFSSFYNTKKKFFTSGTVTVQVLEAIPTRCSWAPGSSPQAASGSLGEEGPGGPGVPDSRTLGHREPGIGACCSCWPGRLCGVSTVLRCCFFINTLLEVAWGAVVTHRAGR

SEQ ID NO: 741964 - protein, 441 aa, Homo sapiens
APPGPRQPGRGVSVWSGYGAGPAAAAAAAAAEADRPGAATAALPRLHAAAAAASSSPARGGGLRPGVGTIPRSAAPLPALRPGAGAGEGTRRLLGVHPPRALPERGGGRGRTSGQRGPRAAARGGGFPKDARRLPAPRCELSLTGSERRVAMPGVTGAPGCPRGPPRWPPRRAVPAPGCRMGCIQSITCKARIRRENIVVYDVCATIDQCPTRIEETSPIVLRYKTPYFKASARVVMPPIPRHETWVVGWIQACNQMEFFNTYSDLGMSSWELPDLREGRVKAISDSDGVSYPWYGNTTETVTLVGPTNKISRFSVSMNDNFYPSVTWAVPVSDSNVPLLTRIKRDQSFTTWLVAMNTTTKEKIILQTIKWRMRVDIEVDPLQLLGQRARLVGRTQQEQPRILSRMEPIPPNALVKPNANDAQVLMWGPKRGPPLVVIPPK

SEQ ID NO: 741965 - protein, 156 aa, Homo sapiens
ARPVLLQPLGLSTPGHSLLAPPGPRQPGRGVSVWSGYGAGPAGAPVAAAAAAASACLLGRPLARRWVRCTRGAAVVQRFMQRRRRRRLLLLPPRRQTDRALPPPPSPGSMPPPLPPPPLRRGAGGSGPGWAPFLAAPLPSLPSARALEPARAPAAS

SEQ ID NO: 741966 - protein, 132 aa, Homo sapiens
ATWSPTQELAAAPYASAVDPLVPSFGVDAAPIRPDSLLFLFPSVCSNHLPRANPSLFLHPALGKSRMGPGALRENCFPWQSWVAALPPTGHRPARCCALGVLPSYHAHGCSPFGLHAIPFCSQTDVYLTSHY

SEQ ID NO: 741967 - protein, 108 aa, Homo sapiens
PVKGGRRAVELGILGRECRPSWEVVPDDLSSLFLHPALGKSRMGPGALRENCFPWQSWVAALPPTGHRPARCCALGVLPSYHAHGCSPFGLHAIPFCSQTDVYLTSHY

SEQ ID NO: 741968 - protein, 133 aa, Homo sapiens
VVGKGDRETGTFSERLGPTSVHSPPLPPFSRLTDSAEQPLPCWMNRHLWKSQLCEMVQPSGGPAADQDVLGEESPLGKQMAEDKASVKAQVTSLLGELQESQSRWECCPLTMHTGALLLGCMLFHFAARPMCI

SEQ ID NO: 741969 - protein, 420 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARWAMGPGALRENCFPWQSWVAALPPTGHRPARCCALGVLPSYHAHGCSPFGLHAIPFCSQTDVYLTSHY

SEQ ID NO: 741970 - protein, 156 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEHGSAGGGAPEEMPAGKDTGYGERRLRAHRAGSRRDQA

SEQ ID NO: 741971 - protein, 220 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATQGQGERELGQGAAAG

SEQ ID NO: 741972 - protein, 285 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGAARGRQGNPGEELWAPCDTSFSVAAGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGEGPARGGPAWGTWARCKV

SEQ ID NO: 741973 - protein, 196 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKGCTWRAPSSAGRSGARTPRPTSAPSRPMPSRTCWPPTGPWTMSAS

SEQ ID NO: 741974 - protein, 440 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 741975 - protein, 440 aa, Homo sapiens; identical to SEQ ID NO: 741974

SEQ ID NO: 741976 - protein, 470 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGCSMESALEAASLHPAQLLGLEKSKGTLDFGADADFVVLDDSLHVQATYISGELVWQADAARQ

SEQ ID NO: 741977 - protein, 440 aa, Homo sapiens; identical to SEQ ID NO: 741974

SEQ ID NO: 741978 - protein, 464 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGKLRQVARTGRMTGLAGSEPLPPPGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 741979 - protein, 334 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRRPADRPPCPSPGAGAGHRCHPCLGPGQRPAHAGTAGSGSGRSDGLRGR

SEQ ID NO: 741980 - protein, 409 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGQ

SEQ ID NO: 741981 - protein, 173 aa, Homo sapiens
MLPFHHRDPGIVGLLTSDRLPAGRCIFYGMIADGTHTNPAALRIAHRAHPQGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 741982 - protein, 417 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGCSMESALEAASLHPAQLLGLEKSKGTLDFGADADFVVLDDSLHVQATYISGELVWQADAARQ

SEQ ID NO: 741983 - protein, 394 aa, Homo sapiens
ARLSSRLGFVTGRGIWPPRGSGAARSRHGSRCAASRARRGPACSSSLTAGSCAEGNCSGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 741984 - protein, 323 aa, Homo sapiens
ARLSSRLGFVTGRGIWPPRGSGAARSRHGSRCAASRARRGPACSSSLTAGSCAEGNCSGGFGVDFSQATEDVGSGVALVARRILSHGVTSFCPTLVTSPPEVYHKVVPQIPVKSGGPHGAGVLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 741985 - protein, 424 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPNFVVLDDSLHVQATYISGELVWQADAARQ

SEQ ID NO: 741986 - protein, 130 aa, Homo sapiens
IAKFGTGQGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 741987 - protein, 346 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGCSMESALEAASLHPAQLLGLEKSKGTLDFGADADFVVLDDSLHVQATYISGELVWQADAARQ

SEQ ID NO: 741988 - protein, 117 aa, Homo sapiens
QGGWVLPSSLLSGGLPAASLSCSPVLPSGRAFWCCRQGQARGCREHCPVPLSICDGSGCLALVVSLGLSFPTSVGLLGSSSGVGGRPHSCPLLIARLCPRLRGARRLPSRPGHLHLG

SEQ ID NO: 741989 - protein, 446 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGTKTLSGSIAPMDVCVRHFLQATGCSMESALEAASLHPAQLLGLEKSKGTLDFGADAAPGGPRSSGRAEAEAPQPEAQAPGSFEGRIAFQGT

SEQ ID NO: 741990 - protein, 283 aa, Homo sapiens
GAAQLSAGVRHWARDLAAAGLRSRSLPTRLTMRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHLDRFHRRSFPA

SEQ ID NO: 741991 - protein, 310 aa, Homo sapiens
EEELRVALEAQSPRRRAGWCSCAGGVLRLGVVTGSRMASDSGNQGTLCTLEFAVQMTCQSCVDAVRKSLQGVAGVQDVEVHLEDQMVLVHTTLPSQEVQALLEGTGRQAVLKGMGSGQLQNLGAAVAILGGPGTVQGVVRFLQLTPERCLIEGTIDGLEPGLHGLHVHQYGDLTNNCNSCGNHFNPDGASHGGPQDSDRHRGDLGNVRADADGRAIFRMEDEQLKVWDVIGRSLIIDEGEDDLGRGGHPLSKITGNSGERLACGIIARSAGLFQNPKQICSCDGLTIWEERGRPIAGKGRKESAQPPAHL

SEQ ID NO: 741992 - protein, 107 aa, Homo sapiens
KPGNAVIIYRPPHLKMEDEQLKVWDVIGRSLIIDEGEDDLGRGGHPLSKITGNSGERLACGIIARSAGLFQNPKQICSCDGLTIWEERGRPIAGKGRKESAQPPAHL

SEQ ID NO: 741993 - protein, 310 aa, Homo sapiens; identical to SEQ ID NO: 741991

SEQ ID NO: 741994 - protein, 121 aa, Homo sapiens
EEELRVALEAQSPRRRAGWCSCAGGVLRLGVVTGSRMASDSGNQGTLCTLEFAVQMTCQSCVDAVRKSLQGVAGVQDVEVHLEDQMVLVHTTLPSQEVQALLEGTGRQAVLKGMGSGQLRE

SEQ ID NO: 741995 - protein, 176 aa, Homo sapiens
TELIIDEGEDGPERCLIEGTIDGLEPGLHGLHVHQYGDLTNNCNSCGNHFNPDGASHGGPQDSDRHRGDLGNVRADADGRAIFRMEDEQLKVWDVIGRSLIIDEGEDDLGRGGHPLSKITGNSGERLACGIIARSAGLFQNPKQICSCDGLTIWEERGRPIAGKGRKESAQPPAHL

SEQ ID NO: 741996 - protein, 121 aa, Homo sapiens; identical to SEQ ID NO: 741994

SEQ ID NO: 741997 - protein, 310 aa, Homo sapiens; identical to SEQ ID NO: 741991

SEQ ID NO: 741998 - protein, 121 aa, Homo sapiens; identical to SEQ ID NO: 741994

SEQ ID NO: 741999 - protein, 121 aa, Homo sapiens; identical to SEQ ID NO: 741994

SEQ ID NO: 742000 - protein, 121 aa, Homo sapiens; identical to SEQ ID NO: 741994

SEQ ID NO: 742001 - protein, 121 aa, Homo sapiens; identical to SEQ ID NO: 741994

SEQ ID NO: 742002 - protein, 121 aa, Homo sapiens; identical to SEQ ID NO: 741994

SEQ ID NO: 742003 - protein, 121 aa, Homo sapiens; identical to SEQ ID NO: 741994

SEQ ID NO: 742004 - protein, 121 aa, Homo sapiens; identical to SEQ ID NO: 741994

SEQ ID NO: 742005 - protein, 121 aa, Homo sapiens; identical to SEQ ID NO: 741994

SEQ ID NO: 742006 - protein, 121 aa, Homo sapiens; identical to SEQ ID NO: 741994

SEQ ID NO: 742007 - protein, 539 aa, Homo sapiens
KRRRGCVGQAAPDRRMSLLSLPWLGLRPVAMSPWLLLLLVVGSWLLARILAWTYAFYNNCRRLQCFPQPPKRNWFWGHLGLITPTEEGLKDSTQMSATYSQGFTVWLGPIIPFIVLCHPDTIRSITNASAAIAPKDNLFIRFLKPWLGEGILLSGGDKWSRHRRMLTPAFHFNILKSYITIFNKSANIMLDKWQHLASEGSSRLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVYDPFRFDPENSKGRSPLAFIPFSAGPRNCIGQAFAMAEMKVVLALMLLHFRFLPDHTEPRRKLELIMRAEGGLWLRVEPLNVGLQ

SEQ ID NO: 742008 - protein, 282 aa, Homo sapiens
MDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVYDPFRFDPENSKGRSPLAFIPFSAGPRNCIGQAFAMAEMKVVLALMLLHFRFLPDHTEPRRKLELIMRAEGGLWLRVEPLNVGLQ

SEQ ID NO: 742009 - protein, 478 aa, Homo sapiens
KRRRGCVGQAAPDRRMSLLSLPWLGLRPVAMSPWLLLLLVVGSWLLARILAWTYAFYNNCRRLQCFPQPPKRNWFWGHLGLITPTEEGLKDSTQMSATYSQGFTVWLGPIIPFIVLCHPDTIRSITNASAAIAPKDNLFIRFLKPWLGEGILLSGGDKWSRHRRMLTPAFHFNILKSYITIFNKSANIMLDKWQHLASEGSSRLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVLPSPFTTTTPILYFCVCVCEFQGS

SEQ ID NO: 742010 - protein, 103 aa, Homo sapiens
MVVLPPPLSLRQPAIVPMGADMRSRSRLPAASASGISPRVGSRLSLPRGNLGLGPIARERALLAPAPPAPSLLSWLSQVQGPPGVTWGTTCLKAVNNSWKRSC

SEQ ID NO: 742011 - protein, 94 aa, Homo sapiens
KFSARGGGDKRTEAGAARLPAASASGISPRVGSRLSLPRGNLGLGPIARERALLAPAPPAPSLLSWLSQVQGPPGVTWGTTCLKAVNNSWKRSC

SEQ ID NO: 742012 - protein, 307 aa, Homo sapiens
MTETTKTHVILLACGSFNPITKGHIQMFERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 742013 - protein, 245 aa, Homo sapiens
MEIQELEEIQACQGLWEVFVTLSERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADVSSKVIAWHPAGTGRDGKCAFDFGLLSSLLLSF

SEQ ID NO: 742014 - protein, 100 aa, Homo sapiens
DQDEETSGGVPGEQRGIPASACPDGEVQTDLQEDGSNSSRPLFPLRNGAPPRHRLGEEVENGMWQGSLSLQRWPFWPSHPFGTPSRKPMAVALCCIPPGL

SEQ ID NO: 742015 - protein, 87 aa, Homo sapiens
GLTLSPRLECSGAVMAPCNLNLSDSSNPPATGRQSMVNAGLADYSPGDLSEDQFSHLENGTTARPLKKIQKTAPHISMFGCCQSTWI

SEQ ID NO: 742016 - protein, 83 aa, Homo sapiens
TSHLTGNIGFEEQAKEQTSIYTNLKKGTFYVVTKSDLNRSPKGTRALWRNSRLGQRTYEEYFVVTERRCSKADGGVKRTQELA

SEQ ID NO: 742017 - protein, 608 aa, Homo sapiens
SRLFSKALKGDHRCGETETPKSCSEVAGCKAAMRHQGKIPEELSLDDRARTQKKWGRGKWEPEPSSKPPREATLEERHARGEKHLGVEIEKTSGEIIRCEKCKRERELQQSLERERLSLGTSELDMGKGPMYDVEKLVRTRSCRRSPEANPASGEEGWKGDSHRSSPRNPTQELRRPSKSMDKKEDRGPEDQESHAQGAAKAKKDLVEVLPVTEEGLREVKKDTRPMSRSKHGGWLLREHQAGFEKLRRTRGEEKEAEKEKKPCMSGGRRMTLRDDQPAKLEKEPKTRPEENKPERPSGRKPRPMGIIAANVEKHYETGRVIGDGNFAVVKECRHRETRQAYAMKIIDKSRLKGKEDMVDSEILIIQSLSHPNIVKLHEVYETDMEIYLILEYVQGGDLFDAIIESVKFPEPDAALMIMDLCKALVHMHDKSIVHRDLKPENLLVQRNEDKSTTLKLADFGLAKHVVRPIFTVCGTPTYVAPEILSEKGYGLEVDMWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSEGHFRSQHKRVVEQVS

SEQ ID NO: 742018 - protein, 113 aa, Homo sapiens
MWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSEGHFRSQHKRVVEQVS

SEQ ID NO: 742019 - protein, 146 aa, Homo sapiens
MCRYRIKHLWHDNSLEVHVNFNVNRSNPKFPCGSAQEFPNMPVFLFKPKGGFSSSVGYPGRQYYFNSSGSSGYQDYYPHGRPDHYEEAPRNYDTYTAGLSEEEQLERALQASLWDRGNTRNSPPPYGFHLSPEEMRRQRLHRFDSQ

SEQ ID NO: 742020 - protein, 300 aa, Homo sapiens
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALKVLNNHYCPGGFVNILGFPVPNRFACWVELVAIHLFSPGTSFAGHLAGILVGLMYTQGPLKKIMEACAGGFSSSVGYPGRQYYFNSSGSSGYQDYYPHGRPDHYEEAPRNYDTYTAGLSEEEQLERALQASLWDRVPCQSPLLWKNSDMT

SEQ ID NO: 742021 - protein, 300 aa, Homo sapiens; identical to SEQ ID NO: 742020

SEQ ID NO: 742022 - protein, 315 aa, Homo sapiens
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALKVLNNHYCPGGFVNILGFPVPNRFACWVELVAIHLFSPGTSFAGHLAGILVGLMYTQGPLKKIMEACAGGFSSSVGYPGRQYYFNSSGSSGYQDYYPHGRPDHYEEAPRNYDTYTAGLSEEEQLERALQASLWDRGNTRNSPPPYGFHLSPEEMRRQRLHRFDSQ

SEQ ID NO: 742023 - protein, 143 aa, Homo sapiens
SNQQQNKHSQRVSFPPRTSFAGHLAGILVGLMYTQGPLKKIMEACAGGFSSSVGYPGRQYYFNSSGSSGYQDYYPHGRPDHYEEAPRNYDTYTAGLSEEEQLERALQASLWDRGNTRNSPPPYGFHLSPEEMRRQRLHRFDSQ

SEQ ID NO: 742024 - protein, 198 aa, Homo sapiens
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALKVLNNHYCPGGFVNILGFPVPNRFACWVELVAIHLFSPGTTCHFVLKI

SEQ ID NO: 742025 - protein, 88 aa, Homo sapiens
PGSPTLRRDQAQRRPLQPTAQLDPGRAPPSGPPDGSSPLRSLLFGQSYSSRTHSVVNWSSSQRESKTMVNEKRPGDRNLQAHPSTNIH

SEQ ID NO: 742026 - protein, 88 aa, Homo sapiens; identical to SEQ ID NO: 742025

SEQ ID NO: 742027 - protein, 137 aa, Homo sapiens
MRTQVYEGLCKNYFSLAVLQRDRIKLLFFDILVFLSVFLLFLLFLVDIMANNTTSLGSPWPENFWEDLIMSFTVSMAIGLVLGGFIWAVFICLFSPSSDKLPWNKQIPFQENQVSELLLSIPFCNVHHFLWKLRVSW

SEQ ID NO: 742028 - protein, 235 aa, Homo sapiens
MRTQVYEGLCKNYFSLAVLQRDRIKLLFFDILVFLSVFLLFLLFLVDIMANNTTSLGSPWPENFWEDLIMSFTVSMAIGLVLGGFIWAVFICLSRRRRASAPISQWSSSRRSRSSYTHGLNRTGFYRHSGCERRSNLSLASLTFQRQASLEQANSFPRKSSFRASTFHPFLQCPPLPVETESQLVTLPSSNISPTISTSHSLSRPDYWSSNSLRVGLSTPPPPAYESIIKAFPDS

SEQ ID NO: 742029 - protein, 160 aa, Homo sapiens
MAIGLVLGGFIWAVFICLSRRRRASAPISQWSSSRRSRSSYTHGLNRTGFYRHSGCERRSNLSLASLTFQRQASLEQANSFPRKSSFRASTFHPFLQCPPLPVETESQLVTLPSSNISPTISTSHSLSRPDYWSSNSLRVGLSTPPPPAYESIIKAFPDS

SEQ ID NO: 742030 - protein, 162 aa, Homo sapiens
MRTQVYEGLCKNYFSLAVLQRDRIKLLFFDILVFLSVFLLFLLFLVDIMANNTTSLGSPWPENFWEDLIMSFTVSMAIGLVLGGFIWAVFICLSRRRRASAPISQWSSSRRSRSSYTHGLNRTGFYRHSGCERRSNLSLASLTFQRQASLEQANSFPSSCGN

SEQ ID NO: 742031 - protein, 607 aa, Homo sapiens
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKAIAIVIPCILALCLLVLVYTVFQFKRKGTPRHILYCKRSMQEWV

SEQ ID NO: 742032 - protein, 457 aa, Homo sapiens
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKVKGDTLSVIQDGWLYKYHWKWILEQRQSVPVLSRQTEKHKTYEELSSITY

SEQ ID NO: 742033 - protein, 329 aa, Homo sapiens
AQRVHQRLRSERPWLRRGGRKVCFPDVSAGRAARLGGGGSWAERGAAGALAPTRARDPSWDPSPRPPPAPPGPLAGMDSAAAAFALDKPALGPGPPPPPPALGPGDCAQARKNFSVSHLLDLEEVAAAGRLAARPGARAEAREGAAREPSGGSSGSEAAPQDGECPSPGRGSAAKRKKKQRRNRTTFNSSQLQALERVFERTHYPDAFVREELARRVNLSEARVQVWFQNRRAKFRRNERAMLASRSASLLKSYSQEAAIEQPVAPRPTALSPDYLSWTASSPYSTVPPYSPGSSGPATPGVNMANSIASLRLKAKEFSLHHSQVPTVN

SEQ ID NO: 742034 - protein, 99 aa, Homo sapiens
MNHTVQTFFSPVNSGQPPNYEMLKEEHEVAVLGAPHNPAPPTSTVIHIRSETSVPDHVVWSLFNTLFMNPCCLGLHSFAYSVKSRDRKMVGDLTGAQAY

SEQ ID NO: 742035 - protein, 176 aa, Homo sapiens
RVCTPDRESAEAAMVRFKHRYLLCELVSDDPRCRLSLDDRVLSSLVRDTIARVHGTFGAAACSIGFAVRYLNAYTGIVLLRCRKEFYQLVWSALPFITYLENKGHRYPCFFNTLHVGGTIRTCQKFLIQYNRRQLLILLQNCTDEGEREAIQKSVTRSCLLEEEEESGEEAAEAME

SEQ ID NO: 742036 - protein, 176 aa, Homo sapiens; identical to SEQ ID NO: 742035

SEQ ID NO: 742037 - protein, 151 aa, Homo sapiens
RVCTPDRESAEAAMVRFKHRYLLCELVSDDPRCRLSLDDRVLSSLVRDTIARVHGTFGAAACSIGFAVRYLNAYTGIVLLRCRKEFYQLVWSGTIRTCQKFLIQYNRRQLLILLQNCTDEGEREAIQKSVTRSCLLEEEEESGEEAAEAME

SEQ ID NO: 742038 - protein, 110 aa, Homo sapiens
RVCTPDRESAEAAMVRFKHRYLLCELVSDDPRCRLSLDDRVLSSLVRDTIARVHGTFGAAACSIGFAGARALGEEGNPGGWRDVEGAGAGGRKKGHEWPSPCTVFCKVSL

SEQ ID NO: 742039 - protein, 118 aa, Homo sapiens
RVCTPDRESAEAAMVRFKHRYLLCELVSDDPRCRLSLDDRVLSSLVRDTIARVHGTFGAAACSIGFAGARALGEEGNPGGWRDVEGAGAGGRKKGHEWPSPCTVFCKVSFDISMPILE

SEQ ID NO: 742040 - protein, 117 aa, Homo sapiens
STLLIHRYLRYLNAYTGIVLLRCRKEFYQLVWSALPFITYLENKGHRYPCFFNTLHVGGTIRTCQKFLIQYNRRQLLILLQNCTDEGEREAIQKSVTRSCLLEEEEESGEEAAEAME

SEQ ID NO: 742041 - protein, 130 aa, Homo sapiens
RVCTPDRESAEAAMVRFKHRYLLCELVSDDPRCRLSLDDRVLSSLVRDTIARVHGTFGAAACSIGFAVRYLNAYTGIVLLRCRKEFYQLVWSALPFITYLENKGHRYPCFFNTLHVGGRSEVVWLLIFNW

SEQ ID NO: 742042 - protein, 126 aa, Homo sapiens
RVCTPDRESAEAAMVRFKHRYLLCELVSDDPRCRLSLDDRVLSSLVRDTIARVHGTFGAAACSIGFAGTIRTCQKFLIQYNRRQLLILLQNCTDEGEREAIQKSVTRSCLLEEEEESGEEAAEAME

SEQ ID NO: 742043 - protein, 67 aa, Homo sapiens
GKGLPKLRGTIRTCQKFLIQYNRRQLLILLQNCTDEGEREAIQKSVTRSCLLEEEEESGEEAAEAME

SEQ ID NO: 742044 - protein, 110 aa, Homo sapiens; identical to SEQ ID NO: 742038

SEQ ID NO: 742045 - protein, 110 aa, Homo sapiens; identical to SEQ ID NO: 742038

SEQ ID NO: 742046 - protein, 87 aa, Homo sapiens
QLPGPSGRCRPRDVTAAEGAGGWAPGEWTVRALPLGPGPWLRPRDGSCSPRAEPVSILDAPWSLKSEKSPYPPTPPCPILGRLGPQS

SEQ ID NO: 742047 - protein, 513 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIIRISDRGGGIAHKDLDRVMDYHFTTAEASTQDPRISPLFGHLDMHSGAQSGPMHGPQLWLRVAHVTGLRGVPRWVSAAAVPAGHWHGRLPAAPPHRWPGGKLPDLTPQPLACSPDQPGPHSLQDLPGQAGRPPAPHTAASWVSGTQTDGLTWSWALPCLNRVHCLLASRTWSREVGTLRPPAPVPSFSFLGNPHSDLLLKFTF

SEQ ID NO: 742048 - protein, 335 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRISDRGGGIAHKDLDRVMDYHFTTAEASTQDPRISPLFGHLDMHSGAQSGPMHG

SEQ ID NO: 742049 - protein, 209 aa, Homo sapiens
MLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIIRISDRGGGIAHKDLDRVMDYHFTTAEASTQDPRISPLFGHLDMHSGAQSGPMHGGQGGSPMLPRAWFFETSWAEGGLLLGIPGRAGHSGVGHLLLKLFF

SEQ ID NO: 742050 - protein, 228 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYFPVAFQEGWTEFQFGLKEPGGEVQYVPAVSKLLVNPGCGGLCARASGEGNIRDETYVFGKRLDGRCGHSQEEIEIVPEGGALTCFSPLSSGQHFLPVRS

SEQ ID NO: 742051 - protein, 151 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDMRTRPVL

SEQ ID NO: 742052 - protein, 58 aa, Homo sapiens
MFVLCTRAVRTLALLSLLLLLLFSASSVLYDSTEEVDSIGRFHSYSSHKFPEVLPSSV

SEQ ID NO: 742053 - protein, 365 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIIRISDRGGGIAHKDLDRVMDYHFTTAEASTQDPRISPLFGHLDMHSGAQSGPMHG

SEQ ID NO: 742054 - protein, 482 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIIRISDRGGGIAHKDLDRVMDYHFTTAEASTQDPRISPLFGHLDMHSGAQSGPMHGCSPCRALARTSTCGSATSMAGRKASGSDPTAFGLLTRPAWAAFPAGPPGSGRAAPCSTHCCILGLRDPDRWTYMELGTALPQQGPLPPRLQNLEQGSGHPEASSTSSVILVPGEPPL

SEQ ID NO: 742055 - protein, 365 aa, Homo sapiens; identical to SEQ ID NO: 742053

SEQ ID NO: 742056 - protein, 82 aa, Homo sapiens
TVGVVGRGRPGLGRPMHRWRDGAGSVDSDPYNFLFPAPVDGSCSPRAEPVSILDAPWSLKSEKSPYPPTPPCPILGRLGPQS

SEQ ID NO: 742057 - protein, 68 aa, Homo sapiens
WLVEPGVNRPRTVEPSLGAGPGSARDGSCSPRAEPVSILDAPWSLKSEKSPYPPTPPCPILGRLGPQS

SEQ ID NO: 742058 - protein, 136 aa, Homo sapiens
GATPAYSVRGGPAAHVRSLHHSAGAQTGLASTIWGASGPNQVTRVGGPAGDSVPHPPKPAPGAQAGVARSLAALPGPGFEGAGQAGAAPPPEKDGSCSPRAEPVSILDAPWSLKSEKSPYPPTPPCPILGRLGPQS

SEQ ID NO: 742059 - protein, 87 aa, Homo sapiens; identical to SEQ ID NO: 742046

SEQ ID NO: 742060 - protein, 413 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIISTSMAGRKASGSDPTAFGLLTRPAWAAFPAGPPGSGRAAPCSTHCCILGLRDPDRWTYMELGTALPQQGPLPPRLQNLEQGSGHPEASSTSSVILVPGEPPL

SEQ ID NO: 742061 - protein, 282 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPHPEASSTSSVILVPGEPPL

SEQ ID NO: 742062 - protein, 239 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFAR

SEQ ID NO: 742063 - protein, 93 aa, Homo sapiens
QLPGPSGRCRPRDVTAAEGAGGWAPGEWTVRALPLGPGPWLRPRDGSCSPRAEPVSILDAPWSLKSEKSPYPPTPPSSLCHWTTSCRSCSRMP

SEQ ID NO: 742064 - protein, 143 aa, Homo sapiens
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPAP

SEQ ID NO: 742065 - protein, 143 aa, Homo sapiens; identical to SEQ ID NO: 742064

SEQ ID NO: 742066 - protein, 125 aa, Homo sapiens
GSGSKGVAWMRGRPGRHVLRPNYNSQDPAGAAAHATSRRRRAQAAGRLASGLFEPFRWDPGPGSGPAVSGATPAYSVRGGPAAHVRSLHHSAGAQTGLASTIWGASGPNQVTRVGGPAGDSVPHP

SEQ ID NO: 742067 - protein, 312 aa, Homo sapiens [sequence omitted]

SEQ ID NO: 742068 - protein, 138 aa, Homo sapiens
GIRAGGESERDAQYEKLRDGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 742069 - protein, 312 aa, Homo sapiens [sequence omitted]

SEQ ID NO: 742070 - protein, 312 aa, Homo sapiens [sequence omitted]

SEQ ID NO: 742071 - protein, 312 aa, Homo sapiens [sequence omitted]

SEQ ID NO: 742072 - protein, 264 aa, Homo sapiens
MAKVFSFILVTTALTMGREISALEDCAQEQMRLRAQVRLLETRVKQQQVKIKQLLQENEVQFLDKGDENTVVDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRFDVL

SEQ ID NO: 742073 - protein, 312 aa, Homo sapiens [sequence omitted]

SEQ ID NO: 742074 - protein, 312 aa, Homo sapiens [sequence omitted]

SEQ ID NO: 742075 - protein, 312 aa, Homo sapiens
MAKVFSFILVTTALIMGREISALEDCAQEQMRLRAQVRLLETRVKQQQVKIKQLLQENEVQFLDKGDENTVVDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 742076 - protein, 282 aa, Homo sapiens
MRLRAQVRLLETRVKQQQVKIKQLLQENEVQFLDKGDENTVVDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 742077 - protein, 312 aa, Homo sapiens; identical to SEQ ID NO: 742075

SEQ ID NO: 742078 - protein, 240 aa, Homo sapiens
MLHYLVLKTDCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 742079 - protein, 312 aa, Homo sapiens [sequence omitted]

SEQ ID NO: 742080 - protein, 349 aa, Homo sapiens
MVSTQSAHYRILGSRVSGWNLSWVSDSLLTLVFSRGNMAKVFSFILVTTALIMGREISALEDCAQEQMRLRAQVRLLETRVKQQQVKIKQLLQENEVQFLDKGDENTVVDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 742081 - protein, 312 aa, Homo sapiens; identical to SEQ ID NO: 742075

SEQ ID NO: 742082 - protein, 282 aa, Homo sapiens; identical to SEQ ID NO: 742076

SEQ ID NO: 742083 - protein, 294 aa, Homo sapiens
MAKVFSFILVTTALIMGREISALEDCAQEQMRLRAQVRLLETRVKQQQVKIKQLLQENEVQFLDKGDENTVVDLGSKRQYADCSEIFNDGYKLSGFYDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 742084 - protein, 1227 aa, Homo sapiens
RGQIPGGGEGPQKTLPDHAVPAAFPATDSTSEGKSVRHPKPSTSESKQSTPSETQTVGAHVLQVCSEHTSHSAHPEPALNLTLASKEIPSKLEAQLGQGKGEAKLDLKYVPPRRVEQEGKAAQEGYLGCHKEENLSALEGRDPCGEAHPEATDALGHLLNSDLHHLGVGRGNCEEKRGVNPGEQDSLHTTPKQGSASLGGADNQPTGKISPCAGEKLGERTSSSFSPGDSHVAFIPNNLTDSKPLDVIEEERRLGSGNKDSVMVLVFNPSVGENKTEVPEPLDPQSGRSEARESKEVTTSVAENRNLLENADKIESTSARADSVLNIPAPLHPETTVNMTYQPTTPSSSFQDVSVFGMDAGSPLVVPPPTDSARLLNTSPKVPDKNTCPSGIPKPVFTHSKDTPSSQEGMENYQVEKTEERTETKPIIMPKPKHVRPKIITYIRRNPQALGQVDASLVPVGLPYAPPTCTMPLPHEEKAAGGDLKPSANLYEKFKPDLQKPRVFSSGLMVSGIKPPGHPFSQMSEKFLQEVTDHPGKEEFCSPPYAHYEVPPTFYRSAMLLKPQLGLGAMSRLPSAKSRILIASQRSSASAIHPPGPITTATSLYSSDPSDLKKASSSNAAKSNLPKSGLRPPGYSRLPAAKLAAFGFVRSSSVSSVSSTQSGDSAQPEQGRPATRSTFGNEEQPVLKASLPSKDTPKGAGRVAPPASSSVTAPRRSLLPAPKSTSTPAGTKKDAPKDQDTNKPAVSSPKRVAASTTKLHSPGYPKQRTAAARNGFPPKPDPQAREAERQLVLRLKERCEQQTRQLGVAQGELKRAICGFDALAVATQHFFRKNESALVKEKELSIELANIRDEVAFHTAKCEKLQKEKEELERRFEDEVKRLGWQQQAELQELEERLQLQFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLAEPMKSCFGSSKLGTRPVRLNSRPHLPFTAAPPRGPPLRPESAQHPDDATTRPAGAPASRPPVSTLREHRPGAAGAGPVRMLSSCECILGASSSDPRVRLPWCRHLGMCKW

SEQ ID NO: 742085 - protein, 348 aa, Homo sapiens
MGHCCCKPYNCLQCLDKTNESALVKEKELSIELANIRDEVAFHTAKCEKLQKEKEELERRFEDEVKRLGWQQQAELQELEERLQLQFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 742086 - protein, 91 aa, Homo sapiens
HGNKLNYIQRSVFYVKANECPYNPQEDTRYDLPLDWMLRRFAAASEDEGALEQRQGSSKARTMPSSHPRLSNLRHGAQAYPGNPTWRVAPD

SEQ ID NO: 742087 - protein, 314 aa, Homo sapiens
MKMSFALTFRSAKGRWIANPSQPCSKASIGLFVPASPPLDPEKVKELQRFITLSKRLLVMTGAGISTESGIPDYRSEKVGLYARTDRRPIQHGDFVRSAPIRQRYWARNFVGWPQFSSHQPNPAHWALSTWEKLGKLYWLVTQNVDALHTKAGSRRLTELHGCMDRVLCLDCGEQTPRGVLQERFQVLNPTWSAEAHGLAPDGDVFLSEEQVRSFQVPTCVQCGGHLKPDVVFFGDTVNPDKVDFVHKRVKEADSLLVVGSSLQVYSGYRFILTAWEKKLPIAILNIGPTRSDDLACLKLNSRCGELLPLIDPC

SEQ ID NO: 742088 - protein, 121 aa, Homo sapiens
PCSSLPINQLPISQRMKMSFALTFRSAKGRWIANPSQPCSKASIGLFVPASPPLDPEKVKELQRFITLSKRLLVMTGAGISTESGIPDYRGASPELSGPNLRSMWRPSETRCRFLRGHSEP

SEQ ID NO: 742089 - protein, 243 aa, Homo sapiens
VRESLSSPCSRSIVLYRKEIKEALLALGSLESWITAGEHAKEGECPPDKNPCKELCQGDELCPAEQKCCTTGCGRICRDIPKGRKRDCPRVIRKQSCLKRCITDETCPGVKKCCTLGCNKSCVVPISKQKLAEFGGECPADPLPCEELCDGDASCPQGHKCCSTGCGRTCLGDIEGGRGGDCPKVLVGLCIVGCVMDENCQAGEKCCKSGCGRFCVPPVLPPKLTMNPNWTVRSDSELEIPVP

SEQ ID NO: 742090 - protein, 88 aa, Homo sapiens
SARKRDAGAAGLPWEPNRRASPRTVTLRGLQKRENALPIRTHAKSCARAMNCVRLNRSAAPQAVVGSAETFLRGGKEIALGLFGNNPV

SEQ ID NO: 742091 - protein, 101 aa, Homo sapiens
SARKRDAGAAGLPWEPNRRASPRTVTLRGLQKRENALPIRTHAKSCARAMNCVRLNRSAAPQAVVGSAETFLRVCWHEGQNLGILSDIASGIDGSRELPTF

SEQ ID NO: 742092 - protein, 136 aa, Homo sapiens
SARKRDAGAAGLPWEPNRRASPRTVTLRGLQKRENALPIRTHAKSCARAMNCVRLNRSAAPQAVVGSAETFLRQSLVVNVPLTPFRVRSCVMGMHPVPRGINAAAPAVAAPASETLREGGAVIVQKFWWACALLAV

SEQ ID NO: 742093 - protein, 140 aa, Homo sapiens
TAFKILFFLLGVAFNIFPSGITCHHSIQFWCDCFLCSSRVLTAQITCGAFPAPQRAPHSPSTQCVLLPGKPLSLSASFSRGSRCADFQLHSFVFGITFTAFSFYSKTPFNIPFYDQPGQHGETPSLLKIQKLARHGGTCL

SEQ ID NO: 742094 - protein, 155 aa, Homo sapiens
MAKSERRIYSMESMAPEISEDIGCPLAYMRESVCALLINQSFFSCVAEMYIPDMNRPGKAERRAEKGLRPPRKLVGETRRLQSWPTLARWLRRVSFSLYKPPIQAAPEPDPGNWAKSPRLSLGPEGITKGKHGFKFQGIKEKFNVSKKVLKMTFL

SEQ ID NO: 742095 - protein, 158 aa, Homo sapiens
LCLLDQFDACARSGLSEPRSLTLRVPSCGKPLPGPGARLGREVTPCLSFAFAWCWLKMCQEEQTSYMVVQTSEEGLAADAELPGPLLMLAQNCAVMHNLLGPACIFLRKGFAENRQPVRKLAQWSPLNLASQGVRRCWDEEGVYTELTPPTYESDPQS

SEQ ID NO: 742096 - protein, 104 aa, Homo sapiens
MRSSHSTASSRASASTWPHWEPGPDLGLLEKVSPLGTLKDRLVGFVVDFIYSCPNPVFLVSIRPRGRCKEFANRACMTYFLGHGKLFLPPFYPLLQPELPSFFS

SEQ ID NO: 742097 - protein, 434 aa, Homo sapiens
GSGGSRSSAQRLGVAARICQGTSLPRLWQRDPVGIEIQLTRCLFPVMDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 742098 - protein, 387 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRYTVLHRGHHQELEKLPIHNDPESLESCF

SEQ ID NO: 742099 - protein, 359 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLR

SEQ ID NO: 742100 - protein, 384 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLSSGTETDRKKLWNKEEKIDQTIQMPK

SEQ ID NO: 742101 - protein, 388 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 742102 - protein, 378 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLSGCSPVSSFLLLFCNRPVPV

SEQ ID NO: 742103 - protein, 360 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRF

SEQ ID NO: 742104 - protein, 138 aa, Homo sapiens
HTDTNSTSTASQRHGVGTVRRFKKAPQGASHGSGQETLVSCRLRVASRASGATVVRLLGVMSPGRREARTACVQDSTSWAELGSSGALSRQKVWPKEAAALSVGNVFLTGVGQKVWPKEAAALSVGDVSPTGIFTVGV

SEQ ID NO: 742105 - protein, 206 aa, Homo sapiens
MFPAAAAGAARARGAACGALGCPAERGGGLAGRRGLCAAPGTLNPSPGLCLLRCFRGDGQGAPGRRRARAGRRGAWSLARTLRSEGKARTKKDQMAKQPSDVSSECDREGRQLQPAERPPQLRPGAPTSLQTEPQDRSPAPMSCDKSTQTPSPPCQAFNHYLSAMVVILEDIGDLSLCFGFIFTGLDLYGHHHSQDTEQLNHKDFS

SEQ ID NO: 742106 - protein, 138 aa, Homo sapiens
MAKQPSDVSSECDREGRQLQPAERPPQLRPGAPTSLQTEPQDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 742107 - protein, 198 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 742108 - protein, 96 aa, Homo sapiens
PPGLQFVGALRPAPLPLPPPPPPPPPPPPPPLPPLILAATLRTLPHCDRIIAVFGSLRSRRHRLGALSWPLFPQMSDSDSRTEKRKKKRPNGKATF

SEQ ID NO: 742109 - protein, 247 aa, Homo sapiens [sequence omitted]

SEQ ID NO: 742110 - protein, 216 aa, Homo sapiens
MTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLSIPHPYAYPDYYPYAWGVIVPLRMHFLAASTKQMFNNHLLNGEEGEEKGLRRGLSRREN

SEQ ID NO: 742111 - protein, 247 aa, Homo sapiens [sequence omitted]

SEQ ID NO: 742112 - protein, 103 aa, Homo sapiens
REGVFHWCNGLAPPGPGRTSDLPSPGFLRLQDQLGRVKRGEGVEGQVRSQSCPGRPPSLSTSSSREPAAHTLLNAGHPRRLLGFEEQTFFPGLSAFCPNFICF

SEQ ID NO: 742113 - protein, 104 aa, Homo sapiens
MGGSLCCCGEGEGFFYRQNWRFLSLDSWDLIQAAHSTHSAIQLYSMHSGISHLLRKDLSFEKGVKPVAAELPGESSEQVIAIVEVSSRLYFGAITSSTVSCLVS

SEQ ID NO: 742114 - protein, 136 aa, Homo sapiens
MGGSLCCCGEGEGFFYRQNWRFLSLDSWDLIQAAHSTHSAIQLYSMHSGISHLLRKDLSFEKVARDPLLRRLRRNTRDDSDTQQLKAEVQAEEKGVKPVAAELPGESSEQVIAIVEVSSRLYFGAITSSTVSCLVS

SEQ ID NO: 742115 - protein, 101 aa, Homo sapiens
CGGLLGSWLGHRLGREGREDGEPGLRWHQNPASASPGLQEQQRLRPWVCQSPQATWKYETCWAAGETMEMRLEAREDPLQEKGGVGEKQAGGSGWPATKAL

SEQ ID NO: 742116 - protein, 115 aa, Homo sapiens
KPRLSTPCPILSPRLLGEKRQELLAQANKLRTGLFKIDETREKVQVMSLELEDAKKKVAEFQKQCEEYLVIIVQQKREADEQQKVQGPRPPPVPHSHQCRLLRQGTHVPPFLNFL

SEQ ID NO: 742117 - protein, 626 aa, Homo sapiens
GRASRAPALRVGFFSPSCVGRGGAFRVPRSSTRAGAEGRGVAAAAGGSRFSLRPEPEAPGPGEPGGGRASGPGGGWGMARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 742118 - protein, 666 aa, Homo sapiens
AGESGARSESRFLFPLLRGAAVVRSEFPGVRRGRVPRGGEWRRRRAAPASASAVASATAVSRQPPAFGQVSAGSDGARAGSWGRARRTFHSLRPEPEAPGPGEPGGGRASGPGGGWGMARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 742119 - protein, 666 aa, Homo sapiens; identical to SEQ ID NO: 742118

SEQ ID NO: 742120 - protein, 534 aa, Homo sapiens
AAARVAVRMAEGWRWCFVRRTPGLLRGPLLPRSFSGNPRALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 742121 - protein, 378 aa, Homo sapiens
MLFQSDIVILHSWRNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 742122 - protein, 641 aa, Homo sapiens
AGESGARSESRFLFPLLRGAAVVRSEFPGVRRGRVPRGGEWRRRRAAPASASAVASATAVSRQPPAFGQVSAGSDGARAGSWGRARRTFHSLRPEPEAPGPGEPGGGRASGPGGGWGMARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNSTRAEFGTSRTLQITPSTSLELGRFAGWLDPEERQQSLQVWLIGSHIH

SEQ ID NO: 742123 - protein, 420 aa, Homo sapiens
AGESGARSESRFLFPLLRGAAVVRSEFPGVRRGRVPRGGEWRRRRAAPASASAVASATAVSRQPPAFGQVSAGSDGARAGSWGRARRTFHSLRPEPEAPGPGEPGGGRASGPGGGWGMARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLSTLGDQARQITRSD

SEQ ID NO: 742124 - protein, 666 aa, Homo sapiens; identical to SEQ ID NO: 742118

SEQ ID NO: 742125 - protein, 666 aa, Homo sapiens; identical to SEQ ID NO: 742118

SEQ ID NO: 742126 - protein, 666 aa, Homo sapiens; identical to SEQ ID NO: 742118

SEQ ID NO: 742127 - protein, 337 aa, Homo sapiens
MESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 742128 - protein, 615 aa, Homo sapiens
AGESGARSESRFLFPLLRGAAVVRSEFPGVRRGRVPRGGEWRRRRAAPASASAVASATAVSRQPPAFGQVSAGSDGARAGSWGRARRTFHSLRPEPEAPGPGEPGGGRASGPGGGWGMARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDVPFKQTSSIAVAGAVIGAVLALFIIAIFVTVLLTPRKKRPSYLDKVMTFHPHINHLLCMKNDPHLGLRKTYFSLNTCLADSVSKKETVGNLQHSNGLNSRSLTMKMRIQLGKMAFSRCTPLYKSNVLPRTEPWKTQSKLRP

SEQ ID NO: 742129 - protein, 296 aa, Homo sapiens
VEGQSRALVIAQELLSSEKAYVEMLQHLNLDFHGAVMRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQGALSLISKVTDRANDSMEQGENLQKLVHIEHSVRGQGDLLQPGREFLKEGTLMKVTGKNRRPRHLFLMNDVLLYTYPQKDGKYRLKNTLAVANMKVSRPVMESAPYALKIETSE

SEQ ID NO: 742130 - protein, 260 aa, Homo sapiens
MRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQGALSLISKVTDRANDSMEQGENLQKLVHIEHSVRGQGDLLQPGREFLKEGTLMKVTGKNRRPRHLFLMNDVLLYTYPQKDGKYRLKNTLAVANMKVSRPVMESAPYALKIETSE

SEQ ID NO: 742131 - protein, 123 aa, Homo sapiens
MVTFLGGFDSHSLNPCVARGKEWVEEQSIMYVPCSVKLHFTKDKQNRGRSQICIYLRLGSGDGLYSPLVPYLGRPPGETWPLVAICLGTKGKTVFCDPASKLNFSLWYSEFGVPRCSFPFTDV

SEQ ID NO: 742132 - protein, 106 aa, Homo sapiens
GPMQGICVIQSTNPESEKPQLCPRERHCPYYSQQQTNLPLLQMEIQSLLCFKAVCYTNIFEKIVWNESCQCFCSENIWKPNIHKELSPTAADTNEQIELFSGQYNK

SEQ ID NO: 742133 - protein, 111 aa, Homo sapiens
TASWLQLSGPWRGRRGLGAVAWVSRRAEAEPGRRALPGLVESAGGLGVPCRVVLSCAAHLRPGHWGREQVCLVPVLGPTGCKEGPPGHGGACGAGWPGRRTGRGEQSFSGI

SEQ ID NO: 742134 - protein, 76 aa, Homo sapiens
AAAVKRDMDLVGADSSVGRAAVAGGPCENTHSDALAAAKAFGSSRRASSVPTLNPWYLCEMWVTPRPNSCSPGSGQ

SEQ ID NO: 742135 - protein, 70 aa, Homo sapiens
AAAVKRDMDLVGADSSVGRAAVAGGPCENTHSDALAAAKAFGSSCLALVSPTFHTGTRGYAWGHCWLSGC

SEQ ID NO: 742136 - protein, 782 aa, Homo sapiens
YSKADSLKQLILKTTTGITEKVLHGQEISVDVDFVTAQSKTMEVKPCPFRPYHSPLLVFKSYRFSPYYRTKEKLPLSSVSYSNMIEPDQCFCRFDLTGTCNDDDCQWQHIQDYTLSRKQLFQDILSYNLSLIGCAETSTNEEITASAEKYVEKLFGVNKDRMSMDQMAVLLVSNINESKGHTPPFTTYKDKRKWKPKFWRKPISDNSFSSDEEQSTGPIKYAFQPENQINVPALDTVVTPDDVRYFTNETDDIANLEASVLENPSHVQLWLKLAYKYLNQNEGECSESLDSALNVLARALENNKDNPEIWCHYLRLFSKRGTKDEVQEMCETAVEYAPDYQSFWTFLHLESTFEEKDYVCERMLEFLMGAAKQETSNILSFQLLEALLFRVQLHIFTGRCQSALAILQNALKSANDGIVAEYLKTSDRCLAWLAYIHLIEFNILPSKFYDPSNDNPSRIVNTESFVMPWQAVQDVKTNPDMLLAVFEDAVKACTDESLAVEERIEACLPLYTNMIALHQLLERYEAAMELCKSLLESCPINCQLLEALVALYLQTNQHDKARAVWLTAFEKNPQNAEVFYHMCKFFILQNRGDNLLPFLRKFIASFFKPGFEKYNNLDLFRYLLNIPGPIDIPSRLCKGNFDDDMFNHQVPYLWLIYCLCHPLQSSIKETVEAYEAALGVAMRCDIVQKIWMDYLVFANNRAAGSRNKVQEFKFFTDLVNRCLVTVPARYPIPFSSADYWSNYEFHNRVIFFYLSCVPKTQHSKTLERFCSVMPANSGLALR

SEQ ID NO: 742137 - protein, 816 aa, Homo sapiens
YSKADSLKQLILKTTTGITEKVLHGQEISVDVDFVTAQSKTMEVKPCPFRPYHSPLLVFKSYRFSPYYRTKEKLPLSSVSYSNMIEPDQCFCRFDLTGTCNDDDCQWQHIQDYTLSRKQLFQDILSYNLSLIGCAETSTNEEITASAEKYVEKLFGVNKDRMSMDQMAVLLVSNINESKGHTPPFTTYKDKRKWKPKFWRKPISDNSFSSDEEQSTGPIKYAFQPENQINVPALDTVVTPDDVRYFTNETDDIANLEASVLENPSHVQLWLKLAYKYLNQNEGECSESLDSALNVLARALENNKDNPEIWCHYLRLFSKRGTKDEVQEMCETAVEYAPDYQSFWTFLHLESTFEEKDYVCERMLEFLMGAAKQETSNILSFQLLEALLFRVQLHIFTGRCQSALAILQNALKSANDGIVAEYLKTSDRCLAWLAYIHLIEFNILPSKFYDPSNDNPSRIVNTESFVMPWQAVQDVKTNPDMLLAVFEDAVKACTDESLAVEERIEACLPLYTNMIALHQLLERYEAAMELCKSLLESCPINCQLLEALVALYLQTNQHDKARAVWLTAFEKNPQNAEVFYHMCKFFILQNRGDNLLPFLRKFIASFFKPGFEKYNNLDLFRYLLNIPGPIDIPSRLCKGNFDDDMFNHQVPYLWLIYCLCHPLQSSIKETVEAYEAALGVAMRCDIVQKIWMDYLVFANNRAAGSRNKVQEFKFFTDLVNRCLVTVPARYPIPFSSADYWSNYEFHNRVIFFYLSCVPKTQHSKTLERFCSVMPANSGLALRLLQHEWEESNVQILKLQAKMFTYNIPTCLATWKM

SEQ ID NO: 742138 - protein, 895 aa, Homo sapiens
YSKADSLKQLILKTTTGITEKVLHGQEISVDVDFVTAQSKTMEVKPCPFRPYHSPLLVFKSYRFSPYYRTKEKLPLSSVSYSNMIEPDQCFCRFDLTGTCNDDDCQWQHIQDYTLSRKQLFQDILSYNLSLIGCAETSTNEEITASAEKYVEKLFGVNKDRMSMDQMAVLLVSNINESKGHTPPFTTYKDKRKWKPKFWRKPISDNSFSSDEEQSTGPIKYAFQPENQINVPALDTVVTPDDVRYFTNETDDIANLEASVLENPSHVQLWLKLAYKYLNQNEGECSESLDSALNVLARALENNKDNPEIWCHYLRLFSKRGTKDEVQEMCETAVEYAPDYQSFWTFLHLESTFEEKDYVCERMLEFLMGAAKQETSNILSFQLLEALLFRVQLHIFTGRCQSALAILQNALKSANDGIVAEYLKTSDRCLAWLAYIHLIEFNILPSKFYDPSNDNPSRIVNTESFVMPWQAVQDVKTNPDMLLAVFEDAVKACTDESLAVEERIEACLPLYTNMIALHQLLERYEAAMELCKSLLESCPINCQLLEALVALYLQTNQHDKARAVWLTAFEKNPQNAEVFYHMCKFFILQNRGDNLLPFLRKFIASFFKPGFEKYNNLDLFRYLLNIPGPIDIPSRLCKGNFDDDMFNHQVPYLWLIYCLCHPLQSSIKETVEAYEAALGVAMRCDIVQKIWMDYLVFANNRAAGSRNKVQEFKFFTDLVNRCLVTVPARYPIPFSSADYWSNYEFHNRVIFFYLSCVPKTQHSKTLERFCSVMPANSGLALRLLQHEWEESNVQILKLQAKMFTYNIPTCLATWKIAIAAEIVLKGQREVHRLYQRALQKLPLCASLWKDQLLFEASEGGKTDNLRKLVSKCQEIGVSLNELLNLNSNKTESKNH

SEQ ID NO: 742139 - protein, 816 aa, Homo sapiens; identical to SEQ ID NO: 742137

SEQ ID NO: 742140 - protein, 604 aa, Homo sapiens
YSKADSLKQLILKTTTGITEKVLHGQEISVDVDFVTAQSKTMEVKPCPFRPYHSPLLVFKSYRFSPYYRTKEKLPLSSVSYSNMIEPDQCFCRFDLTGTCNDDDCQWQHIQDYTLSRKQLFQDILSYNLSLIGCAETSTNEEITASAEKYVEKLFGVNKDRMSMDQMAVLLVSNINESKGHTPPFTTYKDKRKWKPKFWRKPISDNSFSSDEEQSTGPIKYAFQPENQINVPALDTVVTPDDVRYFTNETDDIANLEASVLENPSHVQLWLKLAYKYLNQNEGECSESLDSALNVLARALENNKDNPEIWCHYLRLFSKRGTKDEVQEMCETAVEYAPDYQSFWTFLHLESTFEEKDYVCERMLEFLMGAAKQETSNILSFQLLEALLFRVQLHIFTGRCQSALAILQNALKSANDGIVAEYLKTSDRCLAWLAYIHLIEFNILPSKFYDPSNDNPSRIVNTESFVMPWQAVQDVKTNPDMLLAVFEDAVKACTDESLAVEERIEACLPLYTNMIALHQLLERYEAAMELCKSLLESCPINCQLLEALVALYLQTNQHDKARAVWLTAFEIEAIIFFHFCGNLLHPSLNRGLRSIITWICFGIS

SEQ ID NO: 742141 - protein, 816 aa, Homo sapiens; identical to SEQ ID NO: 742137

SEQ ID NO: 742142 - protein, 816 aa, Homo sapiens; identical to SEQ ID NO: 742137

SEQ ID NO: 742143 - protein, 816 aa, Homo sapiens; identical to SEQ ID NO: 742137

SEQ ID NO: 742144 - protein, 895 aa, Homo sapiens; identical to SEQ ID NO: 742138

SEQ ID NO: 742145 - protein, 780 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRNPSTAFYQAFHLNTLKESKSLWDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 742146 - protein, 780 aa, Homo sapiens; identical to SEQ ID NO: 742145

SEQ ID NO: 742147 - protein, 756 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 742148 - protein, 690 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRNPSTAFYQAFHLNTLKESKSLWDRIFFRIQHRRRNVT

SEQ ID NO: 742149 - protein, 655 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRIW

SEQ ID NO: 742150 - protein, 690 aa, Homo sapiens; identical to SEQ ID NO: 742148

SEQ ID NO: 742151 - protein, 690 aa, Homo sapiens; identical to SEQ ID NO: 742148

SEQ ID NO: 742152 - protein, 710 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDSASGGGVVAIDNKIEQAMLKRMVVLGERQRLKNEETNSDAYELKIATELFGDKTYRVT

SEQ ID NO: 742153 - protein, 780 aa, Homo sapiens; identical to SEQ ID NO: 742145

SEQ ID NO: 742154 - protein, 738 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAELTPMNSLATSVFSIAIPVDGDEDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 742155 - protein, 147 aa, Homo sapiens
SFDVGSSYHCEADSLANPLQLTPMNSLATSVFSIAIPVDGDEDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 742156 - protein, 690 aa, Homo sapiens; identical to SEQ ID NO: 742148

SEQ ID NO: 742157 - protein, 690 aa, Homo sapiens; identical to SEQ ID NO: 742148

SEQ ID NO: 742158 - protein, 691 aa, Homo sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRNPSTAFYQAFHLNTLKESKSLWDRGEITWYLAWDKAAK

SEQ ID NO: 742159 - protein, 126 aa, Homo sapiens
SDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEED

SEQ ID NO: 742160 - protein, 37 aa, Homo sapiens
MYFAKPWLSLTVDLFNTASQVCLCSKKSECLTRGDRG

SEQ ID NO: 742161 - protein, 119 aa, Homo sapiens
MALVSADSRIAELLTELHQLIKQTQGRAFAQNFSVNIQKTHERMQDREQDFSLFTGQSCVASYTTAKADGRRLELTTSFRESFGTKIGEIQVFCFGKERAVFRGQGLPVFYIDFGTPVD

SEQ ID NO: 742162 - protein, 115 aa, Homo sapiens
NTPIVQRKKGNQTSSFFPRLSSAKNLHFRNPEVFKTTVGKRDEFAGLLNSTHKLSREPTRCSLWLPTVLPTPNRELGIRIPGNPLETSHSVSRFLRAVTIVFRSLCPLYLDQVET

SEQ ID NO: 742163 - protein, 73 aa, Homo sapiens
MSDLAERAPRETSWPLKCGVVFSPKKTPRRHRWFDHLEWRLAALRASPRAATNMRRARGKTSSTNRRKQYAMA

SEQ ID NO: 742164 - protein, 120 aa, Homo sapiens
PFLFIQCGVWRRRAEMAPRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKR

SEQ ID NO: 742165 - protein, 1124 aa, Homo sapiens
RTSFVPCPLDWNLLERTPGRTNPAPASTAAMSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNEKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSTPAFVPTKTHVLLHRMSGKGLAAHYFFPRQPCIFGDKMVSIQITLNNTTDRKIENIHIGEKKLPIGMKMHVFNPIDSLEPEGSITVSMGIDFCDSTQTASFQLCTKDDCFNVNIQPPVGELLLPVAMSEKDFKKEQGVLTGMNETSAVIIAAPQNFTPSVIFQKVVNVANVGAVPSGQDNIHRFAAKTVHSGSLMLVTVELKEGSTAQLIINTEKTVIGSVLLRELKPVLSQG

SEQ ID NO: 742166 - protein, 1084 aa, Homo sapiens
RTSFVPCPLDWNLLERTPGRTNPAPASTAAMSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNEKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSTPAFVPTKTHVLLHRMSGKGLAAHYFFPRQPCIFGDKMVSIQITLNNTTDRKIENIHIGEKKLPIGMKMHVFNPIDSLEPEGSITVSMGIDFCDSTQTASFQLCTKDDCFNVNIQPPVGELLLPVAMSEKDFKKEQGVLTGMNETSAVIIAAPQNFTPSVIFQKVVNVANVGAVPSGQDNIHRSLFFLFQVCS

SEQ ID NO: 742167 - protein, 464 aa, Homo sapiens
PFLFIQCGVWRRRAEMAPRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSTPAFVPTKTHVLLHRMSGKGLAAHYFFPRQPCIFGDKMVSIQITLNNTTDRKIENIHIGEKKLPIGMKMHVFNPIDSLEPEGSITVSMGIDFCDSTQTASFQLCTKDDCFNVNIQPPVGELLLPVAMSEKDFKKEQGVLTGMNETSAVIIAAPQNFTPSVIFQKVVNVANVGAVPSGQDNIHRFAAKTVHSGSLMLVTVELKEGSTAQLIINTEKTVIGSVLLRELKPVLSQG

SEQ ID NO: 742168 - protein, 1041 aa, Homo sapiens
RTSFVPCPLDWNLLERTPGRTNPAPASTAAMSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNEKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSTPAFVPTKTHVLLHRMSGKGLAAHYFFPRQPCIFGDKMVSIQITLNNTTDRKIENIHIGEKKLPIGMKMHVFNPIDSLEPEGSITVSMGIDFCDSTQTASFQLCTKDDCFNVNIQPPVGELLLPVAMSEKDFKKEQGERCLQLTRNLHTK

SEQ ID NO: 742169 - protein, 218 aa, Homo sapiens [sequence omitted]

SEQ ID NO: 742170 - protein, 986 aa, Homo sapiens
RTSFVPCPLDWNLLERTPGRTNPAPASTAAMSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNEKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSTPAFVPTKTHVLLHRMSGKGLAAHYFFPRQPCIFGDKMVSIQITLNNTTDRKIENIHIGEKKLPIGMKMHVFNPIALSLVCENEITYFLNPNTKA

SEQ ID NO: 742171 - protein, 893 aa, Homo sapiens
RTSFVPCPLDWNLLERTPGRTNPAPASTAAMSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNEKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSYF

SEQ ID NO: 742172 - protein, 121 aa, Homo sapiens
MSLKFCKCNFQKEINKREPSFAFTGVLTGMNETSAVIIAAPQNFTPSVIFQKVVNVANVGAVPSGQDNIHRFAAKTVHSGSLMLVTVELKEGSTAQLIINTEKTVIGSVLLRELKPVLSQG

SEQ ID NO: 742173 - protein, 780 aa, Homo sapiens
RTSFVPCPLDWNLLERTPGRTNPAPASTAAMSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNEKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGERFLFVFNGGILPVGRPMRNGRGLLPFKPNGPPLVGPLSPREK

SEQ ID NO: 742174 - protein, 114 aa, Homo sapiens
LGISGVEGSLWGRAGSVLLWMTLTLTIARQSLLSLVQPQAPPLPIVSAPGMKHVFLTGLSPEAFEFATPANPSLKRVALSDPFDVRFGVETYFTKFSYINITLCMRQNEDQGDE

SEQ ID NO: 742175 - protein, 111 aa, Homo sapiens
GGVRLQKRNAAHQISAVHLRSEPGCKATWLDWPPLPTSFSQASLQPLHAFILQPGPCQQDCARQDSLYTPRGQWAPQHGQTANETMFSLHEEVTGTRKSLKERGKDLGVCL

SEQ ID NO: 742176 - protein, 240 aa, Homo sapiens
MGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 742177 - protein, 410 aa, Homo sapiens
LTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFSKRSRTYTQHKVSSLNAGDSFNTQNEPEDMMKKEKKSEALNIRGVLLHVMGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 742178 - protein, 260 aa, Homo sapiens
MMKKEKKSEALNIRGVLLHVMGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 742179 - protein, 313 aa, Homo sapiens
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRIAARYGVEPPGLIKLEKEIEQEETLSAPSPSPSPSSKSSGKKSTGNLLDDAVKRISEDPPCKCPNKFCVERLSQGRYRVGEKILFIRMLHNKHVMVRVGGGWETFAGYLLKHDPCRMLQISRVDGKTSPIQSKSPTLKDMNPDNYLVVSASYKAKKEIK

SEQ ID NO: 742180 - protein, 141 aa, Homo sapiens
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLGFGGQ

SEQ ID NO: 742181 - protein, 121 aa, Homo sapiens
ICLQMSLGPELYMVKRISEDPPCKCPNKFCVERLSQGRYRVGEKILFIRMLHNKHVMVRVGGGWETFAGYLLKHDPCRMLQISRVDGKTSPIQSKSPTLKDMNPDNYLVVSASYKAKKEIK

SEQ ID NO: 742182 - protein, 141 aa, Homo sapiens; identical to SEQ ID NO: 742180

SEQ ID NO: 742183 - protein, 153 aa, Homo sapiens [sequence omitted]

SEQ ID NO: 742184 - protein, 88 aa, Homo sapiens
SGCSPCVGMWLTARCLTVLRLLGIPRRTLSHECLKTVSSLPEMDDTCFLINWHLPFQSHHFLYPLGCHKSSSAPQECPLEPRSPLLCP

SEQ ID NO: 742185 - protein, 88 aa, Homo sapiens; identical to SEQ ID NO: 742184

SEQ ID NO: 742186 - protein, 298 aa, Homo sapiens
MACIENVLGGHAPSPLVVSVDKNGNQELHHDMPLQCLSSKPEDDAEPWGQPQVPLRPSVNVLTDLDSKQLEWPSERTGSCIPLHSLRAHRHPYGPPPAVAEESLATAEVNSSDALAGWRQEGQDAINVSWEVSGGPPALIVGGTKVNNGGTERGSNNARLHVALPQGKGFFPPRGPQVRGPSHIPTLRSGIVMEVPPGNTRIACRGKLAHVSFPLRGPCHPMHNWPRPIPLSSSTPGLPSCSTVHCFIPPRPPIFNPFLTMPLPFAPPPIFGPPLPSYFAHFHSGGMPAPASPNREHS

SEQ ID NO: 742187 - protein, 255 aa, Homo sapiens
MYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSNICHYVKFHANRDFAHGIKHNGQEQWLMPVIPALWEAEAGGSPEVKSLRPAWPTAEHPVSAKGAELAGPGHISALAVGA

SEQ ID NO: 742188 - protein, 963 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742189 - protein, 963 aa, Homo sapiens; identical to SEQ ID NO: 742188

SEQ ID NO: 742190 - protein, 963 aa, Homo sapiens; identical to SEQ ID NO: 742188

SEQ ID NO: 742191 - protein, 893 aa, Homo sapiens [sequence omitted]

SEQ ID NO: 742192 - protein, 945 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742193 - protein, 861 aa, Homo sapiens
MYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSNGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742194 - protein, 981 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLECSGTISAHCTLYLPGSSDSAASASQVAVDYSRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742195 - protein, 693 aa, Homo sapiens
MHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742196 - protein, 851 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGPAMAPGTAVKKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742197 - protein, 296 aa, Homo sapiens
MVVLEYPPLFDSSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742198 - protein, 882 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHY

SEQ ID NO: 742199 - protein, 919 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYQLLTVGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742200 - protein, 876 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNPTSR

SEQ ID NO: 742201 - protein, 199 aa, Homo sapiens [sequence omitted]

SEQ ID NO: 742202 - protein, 884 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHCKY

SEQ ID NO: 742203 - protein, 101 aa, Homo sapiens
IELGTVTFVSIIMEPGGGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 742204 - protein, 683 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLECSGTISAHCTLYLPGSSDSAASASQVAGITGMCHHAQPAMLFLRGLHCRPIGRSRKRQKQEAQNRRAD

SEQ ID NO: 742205 - protein, 292 aa, Homo sapiens
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSNICHYVKFHANRDFAHGIKHNGQEQWLMPVIPALWEAEAGGSPEVKSLRPAWPTCRTPCLC

SEQ ID NO: 742206 - protein, 101 aa, Homo sapiens
AVMYRRIPPADESIVCNVLMEFKTLNQRRTCWRGIHVSTWVWLLRVLHPSSLGLRAVAQVPGSSSWLSDLGLLSGGNHWPPVGSSGVNWTTQPSVLSHCPS

SEQ ID NO: 742207 - protein, 1691 aa, Homo sapiens [sequence omitted]

SEQ ID NO: 742208 - protein, 1670 aa, Homo sapiens
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFVVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDNRYKQRCCQSCQEG

SEQ ID NO: 742209 - protein, 216 aa, Homo sapiens
MSEAYFRVESGALGPEENFLSLDDILMSHEKLPVRTETAMPRLGAFFLERSAGAETDNAVPQGSKLELPLWLAKGLFDNKRRILSVELPKIYQEGWRTVFSADPNVVDLHKMGPHFYGFGSQLLHFDSPENADISQSLLQTFIGRFRRIMDSSQNAYNEDTSALVARLDEMERGLFQTGQKGLNDFQCWEKGQASQITASNLVQNYKKRKFTDMED

SEQ ID NO: 742210 - protein, 138 aa, Homo sapiens
MSEAYFRVESGALGPEENFLSLDDILMSHEKLPVRTETAMPRLGAFFLERSAGAETDNAVPQTFIGRFRRIMDSSQNAYNEDTSALVARLDEMERGLFQTGQKGLNDFQCWEKGQASQITASNLVQNYKKRKFTDMED

SEQ ID NO: 742211 - protein, 204 aa, Homo sapiens
MSEAYFRVESGALGPEENFLSLDDILMSHEKLPVRTETAMPRLGAFFLERSAGAETDNAVPQGFALLPRLECSGVIWLTAALTSQAPEILPPQPPMWLVLQGSKLELPLWLAKGLFDNKRRILSVELPKIYQEGWRTVFSADPNVVDLHKMGPHFYGFGSQLLHFDSPENADISQSLLQTFNLDVFADHGSSRCFKKNFSRVPR

SEQ ID NO: 742212 - protein, 236 aa, Homo sapiens
MSEAYFRVESGALGPEENFLSLDDILMSHEKLPVRTETAMPRLGAFFLERSAGAETDNAVPQVEFLVSLVSLTSRMKPKTLVGSKLELPLWLAKGLFDNKRRILSVELPKIYQEGWRTVFSADPNVVDLHKMGPHFYGFGSQLLHFDSPENADISQSLLQTFIGRFRRIMDSSQNAYNEDTSALVARLDEMERGLFQTGQKGLNDFQCWEKGQASQITASNLVQNYKKRKFTDMED

SEQ ID NO: 742213 - protein, 216 aa, Homo sapiens; identical to SEQ ID NO: 742209

SEQ ID NO: 742214 - protein, 101 aa, Homo sapiens
MSEAYFRVESGALGPEENFLSLDDILMSHEKLPVRTETAMPRLGAFFLERSAGAETDNAVPQSNRPDAVATPVIPALWEAEAGGSRGQEIQTILANMVKPH

SEQ ID NO: 742215 - protein, 216 aa, Homo sapiens; identical to SEQ ID NO: 742209

SEQ ID NO: 742216 - protein, 138 aa, Homo sapiens; identical to SEQ ID NO: 742210

SEQ ID NO: 742217 - protein, 252 aa, Homo sapiens
RLGTRPGGAGSPSCTPLTPEAPPNHASGSGEAQVAAMSEAYFRVESGALGPEENFLSLDDILMSHEKLPVRTETAMPRLGAFFLERSAGAETDNAVPQGSKLELPLWLAKGLFDNKRRILSVELPKIYQEGWRTVFSADPNVVDLHKMGPHFYGFGSQLLHFDSPENADISQSLLQTFIGRFRRIMDSSQNAYNEDTSALVARLDEMERGLFQTGQKGLNDFQCWEKGQASQITASNLVQNYKKRKFTDMED

SEQ ID NO: 742218 - protein, 255 aa, Homo sapiens
MSEAYFRVESGALGPEENFLSLDDILMSHEKLPVRTETAMPRLGAFFLERSAGAETDNAVPQGFALLPRLECSGVIWLTAALTSQAPEILPPQPPMWLVLQGSKLELPLWLAKGLFDNKRRILSVELPKIYQEGWRTVFSADPNVVDLHKMGPHFYGFGSQLLHFDSPENADISQSLLQTFIGRFRRIMDSSQNAYNEDTSALVARLDEMERGLFQTGQKGLNDFQCWEKGQASQITASNLVQNYKKRKFTDMED

SEQ ID NO: 742219 - protein, 374 aa, Homo sapiens
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 742220 - protein, 327 aa, Homo sapiens
MLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 742221 - protein, 374 aa, Homo sapiens; identical to SEQ ID NO: 742219

SEQ ID NO: 742222 - protein, 374 aa, Homo sapiens; identical to SEQ ID NO: 742219

SEQ ID NO: 742223 - protein, 367 aa, Homo sapiens
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPAVKRQCYYYFLSKICNAL

SEQ ID NO: 742224 - protein, 367 aa, Homo sapiens; identical to SEQ ID NO: 742223

SEQ ID NO: 742225 - protein, 121 aa, Homo sapiens
EWPNSHLTQSNLCRSLLFAVVQSAVTFHLLFFFIFRDRVSLLLPRLECNDTISAYGDLRLLGSSDSHATASRVAGTTDTRHGKRLIFVFLVETGFHLVAQAGLEFLSLSDLPAPASQSAGI

SEQ ID NO: 742226 - protein, 78 aa, Homo sapiens
RGERQGQRLLSSCDHQQAVTKGAWPGAEVNSGPRSLLGPRKTREGTEIVVEANSRSEDWGGGAKRGLERCWDPELGPQ

SEQ ID NO: 742227 - protein, 73 aa, Homo sapiens
QLLLGEGTDSASDCRGICRKIGETEDTFNCKSPRNSKCKLFRGLLTSHSNHREVIETGSVDKDPQGLGPETSL

SEQ ID NO: 742228 - protein, 160 aa, Homo sapiens
MGPSVLRPLRRAEHPDVARSPKGVGSPLQGPACCLFPAGGVHNGVSKDRFPPLAPLSLSPPSSSAFQPHKGPVRFGTATAQGSEAKSPWVGVFQDTWPCVSCLLSPQPLGSWERDSHGSRARDPWAEPQKWLSILAWAGVGVEARGLAQADEAPSFQGGN

SEQ ID NO: 742229 - protein, 130 aa, Homo sapiens
MRLRPTGLHSQEIRHSKSQDEIGGRHKIQITKTLLIKQVAVKKPAKTHQNQDGDESDSGRPHCYTPISAMTVYRCHSNVWKLPVRSIKGRHEYIHPLFSISSRNNHKNGQPGALGAPLPMEWPFFYSFTF

SEQ ID NO: 742230 - protein, 285 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 742231 - protein, 285 aa, Homo sapiens; identical to SEQ ID NO: 742230

SEQ ID NO: 742232 - protein, 231 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKVPNLPCPSPSQTGSTSSGSCTTWGRSWPCSGSPSGLSSATPSPSDAVRRPPWFSATPPSRTTLTSRILDTAQSSGCISPTVGSTGSSCPGAMMQVRPLHQVPGPAGRGQAAALLPGAH

SEQ ID NO: 742233 - protein, 285 aa, Homo sapiens; identical to SEQ ID NO: 742230

SEQ ID NO: 742234 - protein, 296 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKVPNLALSIPLPDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 742235 - protein, 258 aa, Homo sapiens
MKVTVGPDPSLVYRPDVDPEVAKDKASFRNYTHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 742236 - protein, 270 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 742237 - protein, 313 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEVGGGRGNAARPPGPVLQPQVSRWVALPEAFYMIRFHSFYPWHTGRDYQQLCSQQDLAMLPWVREFNKFDLYTKCPDLPDVDKLRPYYQGLIDKYCPGILSW

SEQ ID NO: 742238 - protein, 320 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFKSTPRYPPRGVVGVKKGVGWGAWGFFTGLTAPPCCSKFDLYTKCPDLPDVDKLRPYYQGLIDKYCPGILSW

SEQ ID NO: 742239 - protein, 348 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEVGGGRGNAARPPGPVLQPQVSRWVALPEAFYMIRFHSFYPWHTGRDYQQLCSQQDLAMLPWVREFKSTPRYPPRGVVGVKKGVGWGAWGFFTGLTAPPCCSKFDLYTKCPDLPDVDKLRPYYQGLIDKYCPGILSW

SEQ ID NO: 742240 - protein, 267 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAATTSSCAASRTWPCCPGCGSSTSSTSTPSARTCRTWTSCGPTTRGSLTSTALAS

SEQ ID NO: 742241 - protein, 241 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNNKFDLYTKCPDLPDVDKLRPYYQGLIDKYCPGILSW

SEQ ID NO: 742242 - protein, 49 aa, Homo sapiens
MIRFHSFYPWHTGRDYQQLCSQQDLAMLPWVREFKSTPRYPPRGVVGVK

SEQ ID NO: 742243 - protein, 108 aa, Homo sapiens
AFYMIRFHSFYPWHTGRDYQQLCSQQDLAMLPWVREFKSTPRYPPRGVVGVKKGVGWGAWGFFTGLTAPPCCSKFDLYTKCPDLPDVDKLRPYYQGLIDKYCPGILSW

SEQ ID NO: 742244 - protein, 125 aa, Homo sapiens
METRSHYIAQAGLELLGSSNPPISASQSTGIKGVSHHAWQRYFQGAVFLKTRKGPQRQFNHQGCHSHHRPRVHRPEPGCRHLRFFCCCCFFSETEFCSCHPGWLECNGAISVHYNLGNRSETPSQ

SEQ ID NO: 742245 - protein, 104 aa, Homo sapiens
MGRIPGGCSSKAFIGRAQWLTPVIPALWEAKGLTLLSRLECSDVIMDHCSPQLTGLRMKGFLAQTPPLEFPVHQYQPGDHVLIKSWKRESLNQLRRTSSGTLDE

SEQ ID NO: 742246 - protein, 104 aa, Homo sapiens; identical to SEQ ID NO: 742245

SEQ ID NO: 742247 - protein, 104 aa, Homo sapiens; identical to SEQ ID NO: 742245

SEQ ID NO: 742248 - protein, 225 aa, Homo sapiens
MLLSGSGGDGVSAKMSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVLGLVRVPLYTQKDRVGGFPNFLSNAFVSTAKCQLLFALKVLNMMPEEKLVEALAAATEKQKKALEKLLPASS

SEQ ID NO: 742249 - protein, 228 aa, Homo sapiens
KLARYEAGFESAGVSAKMSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVLGLVRVPLYTQKDRVGGFPNFLSNAFVSTAKCQLLFALKVLNMMPEEKLVEALAAATEKQKKALEKLLPASS

SEQ ID NO: 742250 - protein, 468 aa, Homo sapiens
KLARYEAGFESAGVSAKMSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVGPPPGPRPPPRGLALAPWKAPMGNTSPEGPLAGLGRVSLSPAMGWGEGSGAGRPGKEGRGWGPALGLPQGCVTSALLPAIANPGSGGVEIGGEEGMGEERGLLGELGNLSTAGVVKLGNLMLGVKALGICTLWSGRAGLRVFRLRWVDGGSMGCGPRGGVAWVRGGGVHGVSLHTCLGRRGLHCSEGAGWLLPGPAWVSHEVLGKAGCSYPGLIASRPLLLEVPLCGRPGPNPYLLSAQVLGLVRVPLYTQKDRVGGFPNFLSNAFVSTAKCQLLFALKVLNMMPEEKLVEALAAATEKQKKALEKLLPASS

SEQ ID NO: 742251 - protein, 251 aa, Homo sapiens
KLARYEAGFESAGVSAKMSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVGPPPGPRPRPGVWLWPRGRHRWVLGLVRVPLYTQKDRVGGFPNFLSNAFVSTAKCQLLFALKVLNMMPEEKLVEALAAATEKQKKALEKLLPASS

SEQ ID NO: 742252 - protein, 225 aa, Homo sapiens; identical to SEQ ID NO: 742248

SEQ ID NO: 742253 - protein, 188 aa, Homo sapiens
KLARYEAGFESAGVSAKMSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVLNMMPEEKLVEALAAATEKQKKALEKLLPASS

SEQ ID NO: 742254 - protein, 1023 aa, Homo sapiens
YKLLFNFVEQNMKIERLVEVKPSLVIDYLKTEKKLFWPKIKKVNVQVSFNPENKQKGILLTGSKTEVLKAVDIVKQVWDSVCVKSVHTDKPGAKQFFQDKARFYQSEIKRLFGCYIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKVSLLLECSFWMVEISSVMVLYKIHFHSLPITFF

SEQ ID NO: 742255 - protein, 1097 aa, Homo sapiens
VNLNTYTATDTKGHSLSVQRLTKSKVDIPAHWSDMKQQNFCVVELLPSDPEYNTVASKFNQTCSHFRIIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 742256 - protein, 1053 aa, Homo sapiens
VNLNTYTATDTKGHSLSVQRLTKSKVDIPAHWSDMKQQNFCVVELLPSDPEYNTVASKFNQTCSHFRIIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVGPLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 742257 - protein, 580 aa, Homo sapiens
MKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 742258 - protein, 420 aa, Homo sapiens
APLPHLRTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 742259 - protein, 365 aa, Homo sapiens
MTGENLVSWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 742260 - protein, 135 aa, Homo sapiens [sequence omitted]

SEQ ID NO: 742261 - protein, 1097 aa, Homo sapiens; identical to SEQ ID NO: 742255

SEQ ID NO: 742262 - protein, 1097 aa, Homo sapiens; identical to SEQ ID NO: 742255

SEQ ID NO: 742263 - protein, 1097 aa, Homo sapiens; identical to SEQ ID NO: 742255

SEQ ID NO: 742264 - protein, 976 aa, Homo sapiens
VNLNTYTATDTKGHSLSVQRLTKSKVDIPAHWSDMKQQNFCVVELLPSDPEYNTVASKFNQTCSHFRIIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKVSLLLECSFWMVEISSVMVLYKIHFHSLPITFF

SEQ ID NO: 742265 - protein, 975 aa, Homo sapiens
VNLNTYTATDTKGHSLSVQRLTKSKVDIPAHWSDMKQQNFCVVELLPSDPEYNTVASKFNQTCSHFRIIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKVNVMIRACSPSYWEAEVEGLHEPRSLTPVWVT

SEQ ID NO: 742266 - protein, 1097 aa, Homo sapiens; identical to SEQ ID NO: 742255

SEQ ID NO: 742267 - protein, 976 aa, Homo sapiens; identical to SEQ ID NO: 742264

SEQ ID NO: 742268 - protein, 1097 aa, Homo sapiens; identical to SEQ ID NO: 742255

SEQ ID NO: 742269 - protein, 1097 aa, Homo sapiens; identical to SEQ ID NO: 742255

SEQ ID NO: 742270 - protein, 1097 aa, Homo sapiens; identical to SEQ ID NO: 742255

SEQ ID NO: 742271 - protein, 1097 aa, Homo sapiens; identical to SEQ ID NO: 742255

SEQ ID NO: 742272 - protein, 976 aa, Homo sapiens; identical to SEQ ID NO: 742264

SEQ ID NO: 742273 - protein, 375 aa, Homo sapiens
VNLNTYTATDTKGHSLSVQRLTKSKVDIPAHWSDMKQQNFCVVELLPSDPEYNTVASKFNQTCSHFRIIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKVSVAFTEHHQGTVTLLSQWLSHGGLKKDKDQGENQGRESHAFHPCLETIFLR

SEQ ID NO: 742274 - protein, 151 aa, Homo sapiens
MAASSQGNFEGDIESVDLAEFAKQQPWWRKLFGPESGLSAEKYSVATHLFIGGVTGWCTGFIFQKVGKLAATAVGGGFFLLQLANHSGYIKVDWQRVEKDMKKAKEQLKIPKSTQIPNQVRSKAEEVVSFVKKNVLVTGGFFGGFLLGMAS

SEQ ID NO: 742275 - protein, 670 aa, Homo sapiens
AGAESLGSPREDSDLFGLIRLPTSGNFDPPRFRTRSRLGGFVQVRLLLGQPLFASAPLRGRTRLGSARRLAAFSVPYSGGGFGRPRPSSGVLFGPRFGLRDRRFGRSRTAPSGRLGGVRMEDSDSAAKQLGLADAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKDWKDHQHICGQSAAVTVQADEVHVAESVMEKVTV

SEQ ID NO: 742276 - protein, 684 aa, Homo sapiens
AGAESLGSPREDSDLFGLIRLPTSGNFDPPRFRTRSRLGGFVQVRLLLGQPLFASAPLRGRTRLGSARRLAAFSVPIRAAASGGLGPARASSSGPASGSATGASGGPGRRLREGSAESGWRTRTRRQSSWAWLKAAAVAAAAAVAAAAAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKDWKDHQHICGQSAAVTVQADEVHVAESVMEKVTV

SEQ ID NO: 742277 - protein, 684 aa, Homo sapiens; identical to SEQ ID NO: 742276

SEQ ID NO: 742278 - protein, 76 aa, Homo sapiens
EIVPRHSSLGGRQSCVNCGREAMSECTGCHKVNYCSTFCQRKDWKDHQHICGQSAAVTVQADEVHVAESVMEKVTV

SEQ ID NO: 742279 - protein, 459 aa, Homo sapiens
AGAESLGSPREDSDLFGLIRLPTSGNFDPPRFRTRSRLGGFVQVRLLLGQPLFASAPLRGRTRLGSARRLAAFSVPIRAAASGGLGPARASSSGPASGSATGASGGPGRRLREGSAESGWRTRTRRQSSWAWLKAAAVAAAAAVAAAAAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGR

SEQ ID NO: 742280 - protein, 100 aa, Homo sapiens
LHCMILLLILSGVNSSGFSELGTHLGLNHPGGSVILQGSSHMVSHHSIVWVKLLYSMADSFHQEEKLQCAKVYQVSAGIMLANVTLVKANHKVKAHIIGK

SEQ ID NO: 742281 - protein, 302 aa, Homo sapiens
MNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILSEVMKKLPLSWFERGKQQSFLSHMAELPTQLPFHIASFH

SEQ ID NO: 742282 - protein, 627 aa, Homo sapiens
MNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQYLQLLCSLFPKSAVSSAQASTNRKGLSDVLVTR

SEQ ID NO: 742283 - protein, 265 aa, Homo sapiens
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 742284 - protein, 293 aa, Homo sapiens
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQYLQLLCSLFPKSAVSSAQASTNRKGLSDVLVTR

SEQ ID NO: 742285 - protein, 466 aa, Homo sapiens
MVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQYLQLLCSLFPKSAVSSAQASTNRKGLSDVLVTR

SEQ ID NO: 742286 - protein, 159 aa, Homo sapiens
MNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLKAPSSSDGVLFCRNQ

SEQ ID NO: 742287 - protein, 364 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGSK

SEQ ID NO: 742288 - protein, 296 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGR

SEQ ID NO: 742289 - protein, 296 aa, Homo sapiens; identical to SEQ ID NO: 742288

SEQ ID NO: 742290 - protein, 136 aa, Homo sapiens
PKSQAHVTMKRELEEGVSGEACGNCCLRVDQWQAAVGQQGQQLGKQAEHRAPEREQLGPAGQVCVCYQVWPGPRIMTSSLPNLVQVSLLVDSTSEPSREGDFCEIQVLAVTKLTFQSSIININKVRVGKDISSACN

SEQ ID NO: 742291 - protein, 106 aa, Homo sapiens
MENCSQVQWVMLVIPAVWQTELGGLLEPRSLRPTWATWRNTISTKNTKISQAWWYTPVIQAECSGMIMAHCSLHLLGSIDPPTSATQVAGITGVVRTAANLVVVGA

SEQ ID NO: 742292 - protein, 101 aa, Homo sapiens
QRLLCPIRLAVGTPAFPLRFLKINPTPRQGRSCCSSTPAPPGTSGKRDFFYKACHSDLNREENNGFFSSRLRKFTFEYLTTKFPINTSKAQKKASWGPYLP

SEQ ID NO: 742293 - protein, 103 aa, Homo sapiens
GAQCGLGQHTTWPPALQSHFRLKVVSESHLRAQGPWPSWLTEFLRSAEPQTEPPWKVHPVTAGSGWGWRCKVPRYSRRFSHHLSTTFRTQPAPVAAGRKNYDL

SEQ ID NO: 742294 - protein, 112 aa, Homo sapiens
LYPGEGSGEGRSVLTCVREVAKKMPKFTACHLVNASCVLSLTSHLPNSAFFLYTQLQSLMCAITSLLLSLPRELKPNSYCVLHPPASFSPCPHPNPHSKYTTDDWSTFPRSS

SEQ ID NO: 742295 - protein, 974 aa, Homo sapiens
MAKAGRAGGPPPGGGAPWHLRNVLSDSVESSDDEFFDAREEMAEGKNAILIGMSQWNSNDLVEQIETMGKLDEHQGEGTAPCTSSILQEKQRELYRVSLRRQRFPAQGSIEIHEDSEEGCPQRSCKTHVLLLVLHGGNILDTGAGDPSCKAADIHTFSSVLEKVTRAHFPAALGHILIKFVPCPAICSEAFSLVSHLNPYSHDEGCLSSSQDHVPLAALPLLAISSPQYQDAVATVIERANQVYREFLKSSDGIGFSGQVCLIGDCVGGLLAFDAICYSAGPSGDSPASSSRKGSISSTQDTPVAVEEDCSLASSKRLSKSNIDISSGLEDEEPKRPLPRKQSDSSTYDCEAITQHHAFLSSIHSSVLKDESETPAAGGPQLPEVSLGRFDFDVSDFFLFGSPLGLVLAMRRTVLPGLDGFQVRPACSQVYSFFHCADPSASRLEPLLEPKFHLVPPVSVPRYQRFPLGDGQSLLLADALHTHSPLFLEGSSRDSPPLLDAPASPPQASRFQRPGRRMSEGSSHSESSESSDSMAPVGASRITAKWWGSKRIDYALYCPDVLTAFPTVALPHLFHASYWESTDVVAFILRQVMRYESVNIKESARLDPAALSPANPREKWLRKRTQVKLRNVTANHRANDVIAAEDGPQVLVGRFMYGPLDMVALTGEKVDILVMAEPSSGRWVHLDTEITNSSGRITYNVPRPRRLGVGVYPVKMVVRGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQECFIKISAAYGSTKDISVYSVLGLPASQIFIVGRPTKKYQTQCQFLSEGYAAHLAALEASHRSRPKKNNSRMILRKGSFGLHAQPEFLRKRNHLRRTMSVQQPDPPAANPKPERAQSQPESDKDHERPLPALSWARGPPKFESVP

SEQ ID NO: 742296 - protein, 893 aa, Homo sapiens
MAKAGRAGGPPPGGGAPWHLRNVLSDSVESSDDEFFDAREEMAEGKNAILIGMSQWNSNDLVEQIETMGKLDEHQGEGTAPCTSSILQEKQRELYRVSLRRQRFPAQGSIEIHEDSEEGCPQRSCKTHVLLLVLHGGNILDTGAGDPSCKAADIHTFSSVLEKVTRAHFPAALGHILIKFVPCPAICSEAFSLVSHLNPYSHDEGCLSSSQDHVPLAALPLLAISSPQYQDAVATVIERANQVYREFLKSSDGIGFSGQVCLIGDCVGGLLAFDAICYSAGPSGDSPASSSRKGSISSTQDTPVAVEEDCSLASSKRLSKSNIDISSGLEDEEPKRPLPRKQSDSSTYDCEAITQHHAFLSSIHSSVLKDESETPAAGGPQLPEVSLGRFDFDVSDFFLFGSPLGLVLAMRRTVLPGLDGFQVRPACSQVYSFFHCADPSASRLEPLLEPKFHLVPPVSVPRYQRFPLGDGQSLLLADALHTHSPLFLEGSSRDSPPLLDAPASPPQASRFQRPGRRMSEGSSHSESSESSDSMAPVGASRITAKWWGSKRIDYALYCPDVLTAFPTVALPHLFHASYWESTDVVAFILRQVMRYESVNIKESARLDPAALSPANPREKWLRKRTQVKLRNVTANHRANDVIAAEDGPQVLVGRFMYGPLDMVALTGEKVDILVMAEPSSGRWVHLDTEITNSSGRITYNVPRPRRLGVGVYPVKMVVRGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQECFIKISAAYGSTKDISVYSVLGLPASQIFIVGRPTKKYQTQCQDCLSPGFKASPGNIARRCFY

SEQ ID NO: 742297 - protein, 457 aa, Homo sapiens [sequence omitted]

SEQ ID NO: 742298 - protein, 364 aa, Homo sapiens
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSRQKNERRGSLESNIRPPTKHVTGKYPRGTSMRSKQRQSARRKTKAADIQANDREHKHTTASDTTRAEKTGERHGESRKST

SEQ ID NO: 742299 - protein, 314 aa, Homo sapiens
AVAVLSVSIREGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRKRWHMLLSATGRAPPGITELLTIRGLAGEAAGSARGRASHGQSWTVHGLETPEEMGWHGGPATRRAHRTTADRRVSEPGGTRGGGSSPRGQRGTR

SEQ ID NO: 742300 - protein, 340 aa, Homo sapiens
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSRGQAARGRLPKTQQPPPPRAGSAPSREESGEQGARATTFLSRVSPPRQPWPASPCR

SEQ ID NO: 742301 - protein, 472 aa, Homo sapiens
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 742302 - protein, 369 aa, Homo sapiens
AGGTARDLRIGGKRAGTARPPPARRAAQTMSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSRGQAARGRLPKTQQPPPPRAGSAPSREESGEQGARATTFLSRVSPPRQPWPASPCR

SEQ ID NO: 742303 - protein, 340 aa, Homo sapiens; identical to SEQ ID NO: 742300

SEQ ID NO: 742304 - protein, 340 aa, Homo sapiens; identical to SEQ ID NO: 742300

SEQ ID NO: 742305 - protein, 199 aa, Homo sapiens
MSVPHPHPPPPSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 742306 - protein, 351 aa, Homo sapiens
QGGGAQWRGETMSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSRGQAARGRLPKTQQPPPPRAGSAPSREESGEQGARATTFLSRVSPPRQPWPASPCR

SEQ ID NO: 742307 - protein, 199 aa, Homo sapiens; identical to SEQ ID NO: 742305

SEQ ID NO: 742308 - protein, 199 aa, Homo sapiens; identical to SEQ ID NO: 742305

SEQ ID NO: 742309 - protein, 199 aa, Homo sapiens; identical to SEQ ID NO: 742305

SEQ ID NO: 742310 - protein, 340 aa, Homo sapiens; identical to SEQ ID NO: 742300

SEQ ID NO: 742311 - protein, 340 aa, Homo sapiens; identical to SEQ ID NO: 742300

SEQ ID NO: 742312 - protein, 344 aa, Homo sapiens
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLR

SEQ ID NO: 742313 - protein, 340 aa, Homo sapiens; identical to SEQ ID NO: 742300

SEQ ID NO: 742314 - protein, 217 aa, Homo sapiens
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLSTRATT

SEQ ID NO: 742315 - protein, 156 aa, Homo sapiens [sequence omitted]

SEQ ID NO: 742316 - protein, 340 aa, Homo sapiens; identical to SEQ ID NO: 742300

SEQ ID NO: 742317 - protein, 399 aa, Homo sapiens
MGSSRCGPGAHPVHLWPPHFAFSGHHPRDLGPHSGPALLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 742318 - protein, 364 aa, Homo sapiens; identical to SEQ ID NO: 742298

SEQ ID NO: 742319 - protein, 239 aa, Homo sapiens [sequence omitted]

SEQ ID NO: 742320 - protein, 130 aa, Homo sapiens
MRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 742321 - protein, 124 aa, Homo sapiens [sequence omitted]

SEQ ID NO: 742322 - protein, 191 aa, Homo sapiens
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGKSNRAPFFSRLTRNTLGNLAWETKPL

SEQ ID NO: 742323 - protein, 126 aa, Homo sapiens
DPISSPFVWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 742324 - protein, 165 aa, Homo sapiens
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKVLGVGSLFLVSFAPLLAHRTNIADLEGSISFPFHKGETEVRVRGPGDGRPMASI

SEQ ID NO: 742325 - protein, 94 aa, Homo sapiens
LEGHALLSYPEEEFLSFLHPEHSRGMLRFMVKEIVRDLDQDGDKQLSVPEFISLPVGTVENQQGQDIDDNWVNNSAGMNNSAGMNNSAGMNNSA

SEQ ID NO: 742326 - protein, 260 aa, Homo sapiens
MVIFSKVDVNTDRKISAKEMQRWIMEKTAEHFQEAMEESKTHFRAVDPDGDGHVSWDEYKVKFLASKGHSEKEVADAIRLNEELKVDEEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 742327 - protein, 260 aa, Homo sapiens; identical to SEQ ID NO: 742326

SEQ ID NO: 742328 - protein, 555 aa, Homo sapiens
MAVADFPDLEACGAYCPCVSDSALFDASVAETARRSGEGYPRGKWITCRRMLGLPRVRRACAGTTYTGSREPIDSAHRGKRRPKGSGWTRVYRRGDLGQAAPLPCACASASEPRGPSSPTVSCLSPSCGRPGDTEPSVVPGDWIGARTSLPPLPLPLPLPAPGPHPAARPMVWPWVAMASRWGPLIGLAPCCLWLLGAVLLMDASARPANHSSTRERVANREENEILPPDHLNGVKLEMDGHLNRGFHQEVRVLPRKGKGNPLALGPFSNGRRTGRGKVPRDPGRTPGESPGRKLMVIFSKVDVNTDRKISAKEMQRWIMEKTAEHFQEAMEESKTHFRAVDPDGDGHVSWDEYKVKFLASKGHSEKEVADAIRLNEELKVDEEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 742329 - protein, 419 aa, Homo sapiens
MAVADFPDLEACGAYCPCVSDSALFDASVAETARRSGEGYPRGKWITCRRMLGLPRVRRACAGTTYTGSREPIDSAHRGKRRPKGSGWTRVYRRGDLGQAAPLPCACASASEPRGPSSPTVSCLSPSCGRPGDTEPSVVPGDWIGARTTRSRGGAGRKLMVIFSKVDVNTDRKISAKEMQRWIMEKTAEHFQEAMEESKTHFRAVDPDGDGHVSWDEYKVKFLASKGHSEKEVADAIRLNEELKVDEEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 742330 - protein, 130 aa, Homo sapiens
MLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 742331 - protein, 219 aa, Homo sapiens
RGSPNCNAGDGHVSWDEYKVKFLASKGHSEKEVADAIRLNEELKVDEEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 742332 - protein, 286 aa, Homo sapiens
MVIFSKVDVNTDRKISAKEMQRWIMEKTAEHFQEAMEESKTHFRAVDPDGDGHVSWDEYKVKFLASKGHSEKEVADAIRLNEELKVDEEESSTSRNFLDLRAGVCRPRYPQAAPLSAQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 742333 - protein, 246 aa, Homo sapiens
MVIFSKVDVNTDRKISAKEMQRWIMEKTAEHFQEAMEESKTHFRAVDPDGDGHVSWDEYKVKFLASKGHSEKEVADAIRLNEELKVDEEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELENVPTLPLQPIGTLNSHFVRLAAELGGGKATLTCAPLARRATWTP

SEQ ID NO: 742334 - protein, 175 aa, Homo sapiens
MLRFMVKEIVRDLGEAGSSLAGTPGPRTDWQGPGIVGRSGQVLREPQPGCGLTHSRLADQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 742335 - protein, 260 aa, Homo sapiens; identical to SEQ ID NO: 742326

SEQ ID NO: 742336 - protein, 260 aa, Homo sapiens; identical to SEQ ID NO: 742326

SEQ ID NO: 742337 - protein, 260 aa, Homo sapiens; identical to SEQ ID NO: 742326

SEQ ID NO: 742338 - protein, 260 aa, Homo sapiens; identical to SEQ ID NO: 742326

SEQ ID NO: 742339 - protein, 260 aa, Homo sapiens; identical to SEQ ID NO: 742326

SEQ ID NO: 742340 - protein, 226 aa, Homo sapiens
MVIFSKVDVNTDRKISAKEMQRWIMEKTAEHFQEAMEESKTHFRAVDPDGDGHVSWDEYKVKFLASKGHSEKEVADAIRLNEELKVDEEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEISLQSLCRRR

SEQ ID NO: 742341 - protein, 184 aa, Homo sapiens
MVIFSKVDVNTDRKISAKEMQRWIMEKTAEHFQEAMEESKTHFRAVDPDGDGHVSWDEYKVKFLASKGHSEKEVADAIRLNEELKVDEEETQEVLENLKDRWYQADSPPADLLLTEEEFLSFLHPEHSRGMLRFMVKEIVRDLDQDGDKQLSVPEFISLPVGTVENQQGQDIDDNWVEIVASHF

SEQ ID NO: 742342 - protein, 82 aa, Homo sapiens
MLRFMVKEIVRDLDQDGDKQLSVPEFISLPVGTVENQQGQDIDDNWVKDRKKEFEELIDSNHDGIVTAEELESYTTQNDTTG

SEQ ID NO: 742343 - protein, 278 aa, Homo sapiens
MAVADFPDLEACGAYCPCVSDSALFDASVAETARRSGEGYPRGKWITCRRMLGLPRVRRACAGTTYTGSREPIDSAHRGKRRPKGSGWTRVYRRGDLGQAAPLPCACASASEPRGPSSPTVSCLSPSCGRPGDTEPSVVPGDWIGARTSLPPLPLPLPLPAPGPHPAARPMVWPWVAMASRWGPLIGLAPCCLWLLGAVLLMDASARPANHSSTRERVANREENEILPPDHLNGVKLEMDGHLNRGFHQEVFLGKDLGGFDELPGPGVSEPPRSRSCR

SEQ ID NO: 742344 - protein, 260 aa, Homo sapiens; identical to SEQ ID NO: 742326

SEQ ID NO: 742345 - protein, 260 aa, Homo sapiens; identical to SEQ ID NO: 742326

SEQ ID NO: 742346 - protein, 242 aa, Homo sapiens
MVIFSKVDVNTDRKISAKEMQRWIMEKTAEHFQEAMEESKTHFRAVDPDGDGHVSWDEYKVKFLASKGHSEKEVADAIRLNEELKVDEEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAGCGPAAPPPPWSLEIVASHF

SEQ ID NO: 742347 - protein, 260 aa, Homo sapiens; identical to SEQ ID NO: 742326

SEQ ID NO: 742348 - protein, 260 aa, Homo sapiens; identical to SEQ ID NO: 742326

SEQ ID NO: 742349 - protein, 258 aa, Homo sapiens
MAVADFPDLEACGAYCPCVSDSALFDASVAETARRSGEGYPRGKWITCRRMLGLPRVRRACAGTTYTGSREPIDSAHRGKRRPKGSGWTRVYRRGDLGQAAPLPCACASASEPRGPSSPTVSCLSPSCGRPGDTEPSVVPGDWIGARTSLPPLPLPLPLPAPGPHPAARPMVWPWVAMASRWGPLIGLAPCCLWLLGAVLLMDASARPANHSSTRERVANREENEILPPDHLNGVKLEMDGHLNRGFHQEVPRSRSCR

SEQ ID NO: 742350 - protein, 274 aa, Homo sapiens
MAVADFPDLEACGAYCPCVSDSALFDASVAETARRSGEGYPRGKWITCRRMLGLPRVRRACAGTTYTGSREPIDSAHRGKRRPKGSGWTRVYRRGDLGQAAPLPCACASASEPRGPSSPTVSCLSPSCGRPGDTEPSVVPGDWIGARTSLPPLPLPLPLPAPGPHPAARPMVWPWVAMASRWGPLIGLAPCCLWLLGAVLLMDASARPANHSSTRERVANREENEILPPDHLNGVKLEMDGHLNRGFHQEVFLGKDLGGFDEVMPARWSPLSVK

SEQ ID NO: 742351 - protein, 77 aa, Homo sapiens
VTRPVPSMCCRPAFSVNGSMRSLGGAGRTVLQPQVCRSVCCLVNVAVSNELYLQEEVAPGFGPGAVVCRPLPHSIGS

SEQ ID NO: 742352 - protein, 514 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742353 - protein, 520 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQIPGRVASSGLQSVVHR

SEQ ID NO: 742354 - protein, 409 aa, Homo sapiens
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742355 - protein, 514 aa, Homo sapiens; identical to SEQ ID NO: 742352

SEQ ID NO: 742356 - protein, 448 aa, Homo sapiens
CPREGFLGSIRSTRRRSARIEALGAAGRQESDGESGAVRGAEPGAGPAVAAAAAPPPRVQTQEAAGRAGANRAAAAMELRVGNRYRLGRKIGSGSFGDIYLVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742357 - protein, 320 aa, Homo sapiens
MLVRDWVCIGEAAQTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742358 - protein, 274 aa, Homo sapiens
MGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742359 - protein, 273 aa, Homo sapiens
MVRGRGGLQRHGDGAVAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742360 - protein, 290 aa, Homo sapiens
LCQRRTWAGEGPRLQHIYTRGQQNVQRFPHSLQTTKVVMGSSELRVCTCVEVQFFFLHLPQVNGSVCVPPVRAIWCSRMASLVMALRISFRLEDLKETAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742361 - protein, 108 aa, Homo sapiens
WNMLKFGASRAADDAELGNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742362 - protein, 111 aa, Homo sapiens
DLSVGGHQATGPDCPGSPGSSLATASHRKPRVRGSRRGRPTPFLSLSSANTSPRPVSGMERERKVSMRLHRGAPVNISSSDLTGRQDTSRMSTSQIPGRVASSGLQSVVHR

SEQ ID NO: 742363 - protein, 100 aa, Homo sapiens
PSPLHSDPSTLPSPVRGHLACMPLPPSRLPVTRSAEHVSQPQRPLCVAGDEASRLGLGGGDSWSGGFQWSSVCRAPMRTLLIAVKGRQCMADLLCYQWLY

SEQ ID NO: 742364 - protein, 520 aa, Homo sapiens; identical to SEQ ID NO: 742353

SEQ ID NO: 742365 - protein, 442 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRHFVGSAAHEVVAPGEAAS

SEQ ID NO: 742366 - protein, 106 aa, Homo sapiens
MEPGAAPGSMLLCPEVPRMPSRLSLRSTWAVASGHVLPTPMRRAVCVRGHFGWTPSRWTMFPLDSRASKVCTLVLPSPPQSSPDAITGWRPRTQLFTPPPAGWPSA

SEQ ID NO: 742367 - protein, 222 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMVRTVS

SEQ ID NO: 742368 - protein, 181 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGGRSLPVTEQHQGSV

SEQ ID NO: 742369 - protein, 108 aa, Homo sapiens; identical to SEQ ID NO: 742361

SEQ ID NO: 742370 - protein, 415 aa, Homo sapiens [sequence omitted]

SEQ ID NO: 742371 - protein, 485 aa, Homo sapiens
CPREGFLGSIRSTRRRSARIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742372 - protein, 352 aa, Homo sapiens
MMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742373 - protein, 366 aa, Homo sapiens
MVMELLGPSLDVVVPLCPALGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742374 - protein, 328 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIGLPPRDRNTKGLARRKCPPPSKCCVKATLPNLPHT

SEQ ID NO: 742375 - protein, 520 aa, Homo sapiens; identical to SEQ ID NO: 742353

SEQ ID NO: 742376 - protein, 173 aa, Homo sapiens
MEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 742377 - protein, 120 aa, Homo sapiens
WVISRILGALTLGRIDVVVGIGKATGPDCPGSPGSSLATASHRKPRVRGSRRGRPTPFLSLSSANTSPRPVSGMERERKVSMRLHRGAPVNISSSDLTGRQDTSRMSTSQNSIPFEHHGK

SEQ ID NO: 742378 - protein, 357 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMLTPGALQATHPATLVGETY

SEQ ID NO: 742379 - protein, 588 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQRSRDMASLRLHAARPARMPSPAPTTHILRAPGPLTGLPARRPLLAPRADPLWNDTVPTPPPSPSKHCSGDDPLGRQLEPSRGPA

SEQ ID NO: 742380 - protein, 485 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRARRMTQPWNAGGRRQRGQPRREVKAAHKKDTSRRNPGVPTAALRFHKPSQGRLAERDRQHPLGSRPPEPLRTDDATATEEA

SEQ ID NO: 742381 - protein, 256 aa, Homo sapiens
RDGGGSFRQLKGDLGPEDPSPSAAGRGQAGPVGAGAAAAALGLSHPPRIEALGAAGRQESDGESGAVRGAEPGAGPAVAAAAAPPPRVQTQEAAGRAGANRAAAAMELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMQRVLPHLVRTFKFSFELLYNLFEMLHCDPGLLELLLCGA

SEQ ID NO: 742382 - protein, 188 aa, Homo sapiens
MAVPGVGLLTRLNLCARRRTRVQRPIVRLLSCPGTVAKDLRRDEQPSGSVETGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESVSF

SEQ ID NO: 742383 - protein, 582 aa, Homo sapiens
MAVPGVGLLTRLNLCARRRTRVQRPIVRLLSCPGTVAKDLRRDEQPSGSVETGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKILSVLGECLDHFGPGCVGVQKILNARCPLVRFSHQASGFQCDLTTNNRIALTSSELLYIYGALDSRVRALVFSVRCWARAHSLTSSIPGAWITNFSLTMMVIFFLQRRSPPILPTLDSLKTLADAEDKCVIEGNNCTFVRDLSRIKPSQNTETLELLLKEFFEYFGNFAFDKNSINIRQGREQNKPDSSPLYIQNPFETSLNISKNVSQSQLQKFVDLARESAWILQQEDTDRPSISSNRPWGLVSLLLPSAPNRKSFTKKKSNKFAIETVKNLLESLKGNRTENFTKTSGKRTISTQT

SEQ ID NO: 742384 - protein, 712 aa, Homo sapiens
MAWAKKVGGRAGQGRSLSRCDPIILDPEWLYGPPEGEGGPEGVGGETRASIHPPLRTGRHHQKVNHNIRGPEGSAKDAAPGGGGHHQAGPGQRGDEDGALQHLCGGGGGVGVSVGRGTGTSVAAEHPSLQVKLLELQELVLRLAGDHNEGHGKFLAAAQNPADDPAPGAPAPQELGAADKQGGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKILSVLGECLDHFGPGCVGVQKILNARCPLVRFSHQASGFQCDLTTNNRIALTSSELLYIYGALDSRVRALVFSVRCWARAHSLTSSIPGAWITNFSLTMMVIFFLQRRSPPILPTLDSLKTLADAEDKCVIEGNNCTFVRDLSRIKPSQNTETLELLLKEFFEYFGNFAFDKNSINIRQGREQNKPDSSPLYIQNPFETSLNISKNVSQSQLQKFVDLARESAWILQQEDTDRPSISSNRPWGLVSLLLPSAPNRKSFTKKKSNKFAIETVKNLLESLKGNRTENFTKTSGKRTISTQT

SEQ ID NO: 742385 - protein, 517 aa, Homo sapiens [sequence omitted]

SEQ ID NO: 742386 - protein, 712 aa, Homo sapiens; identical to SEQ ID NO: 742384

SEQ ID NO: 742387 - protein, 445 aa, Homo sapiens
METAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKILSVLGECLDHFGPGCVGVQKILNARCPLVRFSHQASGFQCDLTTNNRIALTSSELLYIYGALDSRVRALVFSVRCWARAHSLTSSIPGAWITNFSLTMMVIFFLQRRSPPILPTLDSLKTLADAEDKCVIEGNNCTFVRDLSRIKPSQNTETLELLLKEFFEYFGNFAFDKNSINIRQGREQNKPDSSPLYIQNPFETSLNISKNVSQSQLQKFVDLARESAWILQQEDTDRPSISSNRPWGLVSLLLPSAPNRKSFTKKKSNKFAIETVKNLLESLKGNRTENFTKTSGKRTISTQT

SEQ ID NO: 742388 - protein, 366 aa, Homo sapiens [sequence omitted]

SEQ ID NO: 742389 - protein, 564 aa, Homo sapiens
MAVPGVGLLTRLNLCARRRTRVQRPIVRLLSCPGTVAKDLRRDEQPSGSVETGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKILSVLGECLDHFGPGCVGVQKILNARCPLVRFSHQASGFQCDLTTNNRIALTSSELLYIYGALDSRVRALVFSVRCWARAHSLTSSIPGAWITNFSLTMMVIFFLQRRSPPILPTLDSLKTLADAEDKCVIEGNNCTFVRDLSRIKPSQNTETLELLLKEFFEYFGNFAFDKNSINIRQGREQNKPDSSPLYIQNPFETSLNISKNVSQSQLQDRPSISSNRPWGLVSLLLPSAPNRKSFTKKKSNKFAIETVKNLLESLKGNRTENFTKTSGKRTISTQT

SEQ ID NO: 742390 - protein, 204 aa, Homo sapiens
MAWAKKVGGRAGQGRSLSRCDPIILDPEWLYGPPEGEGGPEGVGGETRASIHPPLRTGRHHQKVNHNIRGPEGSAKDAAPGGGGHHQAGPGQRGDEDGALQHLCGGGGGVGVSVGRGTGTSVAAEHPSLQVKLLELQELVLRLAGDHNEGHGKFLAAAQNPADDPAPGAPAPQELGAADKQGDFCEVSRQPGACTRRGQGGLSP

SEQ ID NO: 742391 - protein, 213 aa, Homo sapiens
TYTSGGGLEKLSGDRLDFTQFEEKFIGSAEDLGKLRNDGSLMFQQVPMVEIDGMKLVQTRAILNYIASKYNLYGKDIKERALIDMYTEGMADLNEMILLLPLCRPEEKDAKIALIKEKTKSRYFPAFEKVLQSHGQDYLVGNKLSRADISLVELLYYVEELDSSLISNFPLLKALKTRISNLPTVKKFLQPGSPRKPPADAKALEEARKIFRF

SEQ ID NO: 742392 - protein, 249 aa, Homo sapiens
TYTSGGGLEKLSGDRLDFTQRNQETVTMAGKPKLHYFNGRGRMEPIRWLLAAAGVEFEEKFIGSAEDLGKLRNDGSLMFQQVPMVEIDGMKLVQTRAILNYIASKYNLYGKDIKERALIDMYTEGMADLNEMILLLPLCRPEEKDAKIALIKEKTKSRYFPAFEKVLQSHGQDYLVGNKLSRADISLVELLYYVEELDSSLISNFPLLKALKTRISNLPTVKKFLQPGSPRKPPADAKALEEARKIFRF

SEQ ID NO: 742393 - protein, 72 aa, Homo sapiens
SLRAACLPSIVGGVANSEPQLLCLFLQGVRPWDGGGWAQRASVACEWSSAVSWPRRVGAKPLARCLASTSIQ

SEQ ID NO: 742394 - protein, 136 aa, Homo sapiens
KFHRGLCMVVSQLCICVCEMCFLYRYKSLKVTALESFCWNKLPSNPYVCTRGKSRNITVRKHRVVYGKIWTQRVCRARKSQLLSMGEFARINDDDMLTVIMLIMLIMIKMKLFSTHAFSPFDISEVGNILRFSGKS

SEQ ID NO: 742395 - protein, 125 aa, Homo sapiens
SPELNRDPFTSRQAPFIPNSRGHCSLPLATRCVPEPQLSSPEFMQVTVTSARVLLPPSWPHSQLPSQPTDGPMQSRWQCLPNPCPPARPHVWERPCSPLAPTRFPPLATACVSPASQPQRQACPP

SEQ ID NO: 742396 - protein, 360 aa, Homo sapiens
MSQGRGKYDFYIGLGLAMSSSIFIGGSFILKKKGLLRLARKGSMRAGQGGHAYLKEWLWWAGLLSMGAGEVANFAAYAFAPATLVTPLGALSVLVSAILSSYFLNERLNLHGKIGCLLSILGSTVMVIHAPKEEEIETLNEMSHKLGDPGFVVFATLVVIVALILIFVVGPRHGQTNILVYITICSVIGAFSVSCVKGLGIAIKELFAGKPVLRHPLAWILLLSLIVCVSTQINYLNRALDIFNTSIVTPIYYVFFTTSVLTCSAILFKEWQDMPVDDVIGTLSGFFTIIVGIFLLHAFKDVSFSLASLPVSFRKDEKAMNGNLSNMYEVLNNNEESLTCGIEQHTGENVSRRNGNLTAF

SEQ ID NO: 742397 - protein, 360 aa, Homo sapiens; identical to SEQ ID NO: 742396

SEQ ID NO: 742398 - protein, 360 aa, Homo sapiens; identical to SEQ ID NO: 742396

SEQ ID NO: 742399 - protein, 360 aa, Homo sapiens; identical to SEQ ID NO: 742396

SEQ ID NO: 742400 - protein, 360 aa, Homo sapiens; identical to SEQ ID NO: 742396

SEQ ID NO: 742401 - protein, 360 aa, Homo sapiens; identical to SEQ ID NO: 742396

SEQ ID NO: 742402 - protein, 360 aa, Homo sapiens; identical to SEQ ID NO: 742396

SEQ ID NO: 742403 - protein, 360 aa, Homo sapiens; identical to SEQ ID NO: 742396

SEQ ID NO: 742404 - protein, 360 aa, Homo sapiens; identical to SEQ ID NO: 742396

SEQ ID NO: 742405 - protein, 360 aa, Homo sapiens; identical to SEQ ID NO: 742396

SEQ ID NO: 742406 - protein, 342 aa, Homo sapiens
MSQGRGKYDFYIGLGLAMSSSIFIGGSFILKKKGLLRLARKGSMRAGQGGHAYLKEWLWWAGLLSMGAGEVANFAAYAFAPATLVTPLGALSVLVSAILSSYFLNERLNLHGPKEEEIETLNEMSHKLGDPGFVVFATLVVIVALILIFVVGPRHGQTNILVYITICSVIGAFSVSCVKGLGIAIKELFAGKPVLRHPLAWILLLSLIVCVSTQINYLNRALDIFNTSIVTPIYYVFFTTSVLTCSAILFKEWQDMPVDDVIGTLSGFFTIIVGIFLLHAFKDVSFSLASLPVSFRKDEKAMNGNLSNMYEVLNNNEESLTCGIEQHTGENVSRRNGNLTAF

SEQ ID NO: 742407 - protein, 93 aa, Homo sapiens
HLAAPRFSGIGLGPGSGGDGGAGGCPWQVFLGASPWRRRCERLQPRMLASPTGRRRRRWPCERRTGRPVWGCEPRCPRLRRRGEAARPAGRLG

SEQ ID NO: 742408 - protein, 657 aa, Homo sapiens
SAPPPRRRRRRRRHSPLGRRRRSWRCPGSLAGKQLRGRRGGPRRPKRLAGGAVGWVLLVRGVHSVRAGGGRPPRAADMKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYP

SEQ ID NO: 742409 - protein, 125 aa, Homo sapiens
VRTQLLSFCVFSASHARLRCMCTCNRCTFCICQNFLNSDLLQSVKNKIFTAVLNRFLTLFTGYPGILLKYKRKKRITIYYTDTHYKDKLTDAQLTSTKILTVMTMFSFGSILNNVFILIGIFRGL

SEQ ID NO: 742410 - protein, 695 aa, Homo sapiens
SAPPPRRRRRRRRHSPLGRRRRSWRCPGSLAGKQLRGRRGGPRRPKRLAGGAVGWVLLVRGVHSVRAGGGRPPRAADMKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHVTQADLKSSTFWLRASFGATVFAVLGFAMYKALLKQR

SEQ ID NO: 742411 - protein, 491 aa, Homo sapiens
METILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHVTQADLKSSTFWLRASFGATVFAVLGFAMYKALLKQR

SEQ ID NO: 742412 - protein, 768 aa, Homo sapiens
SAPPPRRRRRRRRHSPLGRRRRSWRCPGSLAGKQLRGRRGGPRRPKRLAGGAVGWVLLVRGVHSVRAGGGRPPRAADMKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPEDHYRDRLSRDMGHTDRIENLRKIWVFLKTAFHARLRCMCTCNRCTFCICQNFLNSDLLQSVKNKIFTAVLNRHVTQADLKSSTFWLRASFGATVFAVLGFAMYKALLKQR

SEQ ID NO: 742413 - protein, 736 aa, Homo sapiens
SAPPPRRRRRRRRHSPLGRRRRSWRCPGSLAGKQLRGRRGGPRRPKRLAGGAVGWVLLVRGVHSVRAGGGRPPRAADMKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHARLRCMCTCNRCTFCICQNFLNSDLLQSVKNKIFTAVLNRHVTQADLKSSTFWLRASFGATVFAVLGFAMYKALLKQR

SEQ ID NO: 742414 - protein, 727 aa, Homo sapiens
SAPPPRRRRRRRRHSPLGRRRRSWRCPGSLAGKQLRGRRGGPRRPKRLAGGAVGWVLLVRGVHSVRAGGGRPPRAADMKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPEDHYRDRLSRDMGHTDRIENLRKIWVFLKTALHVTQADLKSSTFWLRASFGATVFAVLGFAMYKALLKQR

SEQ ID NO: 742415 - protein, 768 aa, Homo sapiens; identical to SEQ ID NO: 742412

SEQ ID NO: 742416 - protein, 598 aa, Homo sapiens
SAPPPRRRRRRRRHSPLGRRRRSWRCPGSLAGKQLRGRRGGPRRPKRLAGGAVGWVLLVRGVHSVRAGGGRPPRAADMKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKEKTGNNQDG

SEQ ID NO: 742417 - protein, 167 aa, Homo sapiens
RTRGIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLLHVLASSKFWCYCFCSFGLCYVQSIIETAMI

SEQ ID NO: 742418 - protein, 768 aa, Homo sapiens; identical to SEQ ID NO: 742412

SEQ ID NO: 742419 - protein, 695 aa, Homo sapiens; identical to SEQ ID NO: 742410

SEQ ID NO: 742420 - protein, 768 aa, Homo sapiens
SAPPPRRRRRRRRHSPLGRRRRSWRCPGSLAGKQLRGRRGGPRRPKRLAGGAVGWVLLVRGVHSVRAGGGRPPRAADMKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHARLRCMCTCNRCTFCICQNFLNSDLLQSVKNKIFTAVLNRFLTLFTGYPGILLKYKRKKRITIYYTDTHYKDKLTDAQLTSTKILTVMTMFSFGSILNNVFILIGIFRGL

SEQ ID NO: 742421 - protein, 657 aa, Homo sapiens; identical to SEQ ID NO: 742408

SEQ ID NO: 742422 - protein, 239 aa, Homo sapiens
SAPPPRRRRRRRRHSPLGRRRRSWRCPGSLAGKQLRGRRGGPRRPKRLAGGAVGWVLLVRGVHSVRAGGGRPPRAADMKKDVRILLVGERESAPSGRPLSPCPPCPCSPCRPCRPCSPNLCSPGPSRASQLRSPFSAFLGLPAPSLFSFGWPPAALTLSPHLGPPEISFPCSPAVLPSHVPISPNRPTSSLRSFSPPFPLRTLSFWASQFPRPPPFRPSCLLEIPLSLPGRCWNKQTDQ

SEQ ID NO: 742423 - protein, 73 aa, Homo sapiens
TEDQVGTLCLKQHLYLPSHGKGASETHPDLVDETKLVNTQFHLTPYWQPMLTLFPGWQVKKVGIGDFGKDVSG

SEQ ID NO: 742424 - protein, 626 aa, Homo sapiens
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 742425 - protein, 443 aa, Homo sapiens
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRVSFMISCFQMNDQGLYLWLLVIRVD

SEQ ID NO: 742426 - protein, 102 aa, Homo sapiens
RQSATLAPMLECSGTILAHCNLHLAGSSDSRASASRVAGITGTCHHTQLIFIFLVEMGFHHVGQAGLELLTSGDSPPPPHPPASQSGGITGMSHRPGRNYHF

SEQ ID NO: 742427 - protein, 626 aa, Homo sapiens; identical to SEQ ID NO: 742424

SEQ ID NO: 742428 - protein, 626 aa, Homo sapiens; identical to SEQ ID NO: 742424

SEQ ID NO: 742429 - protein, 626 aa, Homo sapiens; identical to SEQ ID NO: 742424

SEQ ID NO: 742430 - protein, 626 aa, Homo sapiens; identical to SEQ ID NO: 742424

SEQ ID NO: 742431 - protein, 698 aa, Homo sapiens
SQYSQQSSSYGQQKPTAEEGSPASPGPEPGPLAVPGSTAGASPRRTSAPPTLSASAGETPSPTIQRARYPPDMPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 742432 - protein, 69 aa, Homo sapiens
PVLAVPLSSCGLKGVVYLLSVHVYSSAQSMRRTIALTSQRFREDQMTQSEEMNHYCYLLSLLSSEANVW

SEQ ID NO: 742433 - protein, 129 aa, Homo sapiens
GILWMFASPSFLLELTPAVKPAFFSGPRCVTLSGVDAENEADVSKNEGLRHPQYPLLWERGREQSGFALPKFGAPVSFLRRLPKTFPLFSWAVLPPWEGRRRRAMLHAVERTHLFFLEQSLGTFWSECL

SEQ ID NO: 742434 - protein, 403 aa, Homo sapiens
MEPAGPCGFCPAGEVQPARYTCPRCNAPYCSLRCYRTHGTCAENFYRDQVLGELRGCSAPPSRLASALRRLRQQRETEDEPGEAGLSSGPAPGGLSGLWERLAPGEKAAFERLLSRGEAGRLLPPWRPWWWNRGAGPQLLEELDNAPGSDAAELELAPARTPPDSVKDASAAEPAAAERVLGDVPGACTPVVPTRIPAIVSLSRGPVSPLVRFQLPNVLFAYAHTLALYHGGDDALLSDFCATLLGVSGALGAQQVFASAEEALQAAAHVLEAGEHPPGPLGTRGAMHEVARILLGEGPTNQKGYTLAALGDLAQTLGRARKQAVAREERDHLYRARKKCQFLLAWTNENEAALTPLALDCARAHQAHAVVAEEVAALTGELERLWGGPVPPAPRTLIEELPS

SEQ ID NO: 742435 - protein, 378 aa, Homo sapiens
MAPAQKTSPVPGVERAPFPPRPRGFQGRALSPFLPPARLASALRRLRQQRETEDEPGEAGLSSGPAPGGLSGLWERLAPGEKAAFERLLSRGEAGRLLPPWRPWWWNRGAGPQLLEELDNAPGSDAAELELAPARTPPDSVKDASAAEPAAAERVLGDVPGACTPVVPTRIPAIVSLSRGPVSPLVRFQLPNVLFAYAHTLALYHGGDDALLSDFCATLLGVSGALGAQQVFASAEEALQAAAHVLEAGEHPPGPLGTRGAMHEVARILLGEGPTNQKGYTLAALGDLAQTLGRARKQAVAREERDHLYRARKKCQFLLAWTNENEAALTPLALDCARAHQAHAVVAEEVAALTGELERLWGGPVPPAPRTLIEELPS

SEQ ID NO: 742436 - protein, 322 aa, Homo sapiens
SHIKWSEKEGRGALRTWTVRLAPGEKAAFERLLSRGEAGRLLPPWRPWWWNRGAGPQLLEELDNAPGSDAAELELAPARTPPDSVKDASAAEPAAAERVLGDVPGACTPVVPTRIPAIVSLSRGPVSPLVRFQLPNVLFAYAHTLALYHGGDDALLSDFCATLLGVSGALGAQQVFASAEEALQAAAHVLEAGEHPPGPLGTRGAMHEVARILLGEGPTNQKGYTLAALGDLAQTLGRARKQAVAREERDHLYRARKKCQFLLAWTNENEAALTPLALDCARAHQAHAVVAEEVAALTGELERLWGGPVPPAPRTLIEELPS

SEQ ID NO: 742437 - protein, 117 aa, Homo sapiens [sequence omitted]

SEQ ID NO: 742438 - protein, 113 aa, Homo sapiens
MTSKQQRSTSIEETMRPQEKQVTITETLWDQVLTVFKDIQKELQEDARIRGMSNCSMTPMTSAPRTGSIRPPDSLMTPKLRRLQFSSGEQPSGGRIHNLKTQLFSQSAYYPGP

SEQ ID NO: 742439 - protein, 113 aa, Homo sapiens; identical to SEQ ID NO: 742438

SEQ ID NO: 742440 - protein, 357 aa, Homo sapiens
ADEGSLVGKMAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 742441 - protein, 356 aa, Homo sapiens
PEWRIRHEMAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 742442 - protein, 368 aa, Homo sapiens
ADEGSLVGKMAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQEPRRGDILQEIQRVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 742443 - protein, 203 aa, Homo sapiens
MDKERRICMGMAWQSGTQRIGCSQRVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 742444 - protein, 210 aa, Homo sapiens
MQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 742445 - protein, 203 aa, Homo sapiens; identical to SEQ ID NO: 742443

SEQ ID NO: 742446 - protein, 357 aa, Homo sapiens; identical to SEQ ID NO: 742440

SEQ ID NO: 742447 - protein, 357 aa, Homo sapiens; identical to SEQ ID NO: 742440

SEQ ID NO: 742448 - protein, 357 aa, Homo sapiens; identical to SEQ ID NO: 742440

SEQ ID NO: 742449 - protein, 321 aa, Homo sapiens
ADEGSLVGKMAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPESEHRGPREMVP

SEQ ID NO: 742450 - protein, 372 aa, Homo sapiens
EKGEEGGGAPRHGVLRGARARAGAGPGRAMSRAGSWDMDGLRADGGGAGGAPASSSSSSVAAAAASGQCRGFLSAPVFAGTHSGRAAAAAAAAAAAAAAASGFAYPGTSERTGSSSSSSSSAVVAARPEAPPAKECPAPTPAAAAAAPPSAPALGYGYHFGNGYYSCRMSHGVGLQQNALKSSPHASLGGFPVEKYMDVSGLASSSVPANEVPARAKEVSFYQGYTSPYQHVPGYIDMVSTFGSGEPRHEAYISMEGYQSWTLANGWNSQVYCTKDQPQGSHFWKSSFPGDVALNQPDMCVYRRGRKKRVPYTKLQLKELENEYAINKFINKDKRRRISAATNLSERQVTIWFQNRRVKDKKIVSKLKDTVS

SEQ ID NO: 742451 - protein, 747 aa, Homo sapiens [sequence omitted]

SEQ ID NO: 742452 - protein, 284 aa, Homo sapiens
MAEAVERTDELVREYLLFRGFTHTLRQLDAEIKADKEKGFRVDKIVDQLQQLMQVYDLAALRDYWSYLERRLFSRLEDIYRPTIHKLKTSLFRFYLVYTIQTNRNDKAQEFFAKQATELQNQAEWKDWFVLPFLPSPDTNPTFATYFSRQWADTFIVSLHNFLSVLFQCMPVPVILNFDAECQRTNQVQEENEVLRQKLFALQAEIHRLKKEEQQPEEEEALVQHKLPPYVSNMDRLGDSELHFVWASCPRCCLRVRRAPQGCRLLRALLNLRARPRKSPSVVR

SEQ ID NO: 742453 - protein, 44 aa, Homo sapiens
MSWRAHYGEVYSVEFSYDENTVYSIGEDGKVGGCRIQIREHRDD

SEQ ID NO: 742454 - protein, 636 aa, Homo sapiens
MAEAVERTDELVREYLLFRGFTHTLRQLDAEIKADKEKGFRVDKIVDQLQQLMQVYDLAALRDYWSYLERRLFSRLEDIYRPTIHKLKTSLFRFYLVYTIQTNRNDKAQEFFAKQATELQNQAEWKDWFVLPFLPSPDTNPTFATYFSRQWADTFIVSLHNFLSVLFQCMPVPVILNFDAECQRTNQVQEENEVLRQKLFALQAEIHRLKKEEQQPEEEEALVQHKLPPYVSNMDRLGDSELAMVCSQRNASLSQSLRVGFLSSLLPQSKKSPSRLSPAQGPPQPQSSAKKESFGGQGTKGKDPTSGAKDGKSLLSGLATGESGWSQHRQRRLQDHGKERKELFSTTTSQCAEKKPEASGPEAEPCPELHTEPVEPLTRASSAGPEGGGVRPEQPFIVLGQEEYGEHHSSIMHCRVDCSGRRVASLDVDGVIKVWSFNPIMQTKASSISKSPLLSLEWATKRDRLLLLGSGVGTVRLYDTEAKKNLCEININDNMPRILSLACSPNGASFVCSAAAPSLTSQVDFSAPDIGSKGMNQVPGRLLLWDTKTMKQQLQFSLDPEPIAINCTAFNHNGNLLVTGAADGVIRLFVHPVEHPQEWPQGIRVQPPLRCHGPLCAVWIQRLQAGSSPQGPTLRF

SEQ ID NO: 742455 - protein, 739 aa, Homo sapiens
DASAAMAEAVERTDELVREYLLFRGFTHTLRQLDAEIKADKEKGFRVDKIVDQLQQLMQVYDLAALRDYWSYLERRLFSRLEDIYRPTIHKLKTSLFRFYLVYTIQTNRNDKAQEFFAKQATELQNQAEWKDWFVLPFLPSPDTNPTFATYFSRQWADTFIVSLHNFLSVLFQCMPVPVILNFDAECQRTNQVQEENEVLRQKLFALQAEIHRLKKEEQQPEEEEALVQHKLPPYVSNMDRLGDSELAMVCSQRNASLSQSLRVGFLSSLLPQSKKSPSRLSPAQGPPQPQSSAKKESFGGQGTKGKDPTSGAKDGKSLLSGLATGESGWSQHRQRRLQDHGKERKELFSTTTSQCAEKKPEASGPEAEPCPELHTEPVEPLTRASSAGPEGGGVRPEQPFIVLGQEEYGEHHSSIMHCRVDCSGRRVASLDVDGVIKVWSFNPIMQTKASSISKSPLLSLEWATKRDRLLLLGSGVGTVRLYDTEAKKNLCEININDNMPRILSLACSPNGASFVCSAAAPSLTSQVDFSAPDIGSKGMNQVPGRLLLWDTKTMKQQCTAFNHNGNLLVTGAADGVIRLFDMQQHECAMSWRAHYGEVYSVEFSYDENTVYSIGEDGKFIQWNIHKSGLKVSEYSLPSDATGPFVLSGYSGYKQVQVPRGRLFAFDSEGNYMLTCSATGGVIYKLGGDEKVLESCLSLGGHRAPVVTVDWSTAMDCGTCLTASMDGKIKLTTLLAHKA

SEQ ID NO: 742456 - protein, 636 aa, Homo sapiens; identical to SEQ ID NO: 742454

SEQ ID NO: 742457 - protein, 336 aa, Homo sapiens [sequence omitted]

SEQ ID NO: 742458 - protein, 307 aa, Homo sapiens
EPTPHHQGRRLPSVVRGAGPFPSLMPHLLCRIQPQDQSAPSLCGQAEGLTQAHVCCRILSLACSPNGASFVCSAAAPSLTSQVDFSAPDIGSKGMNQVPGRLLLWDTKTMKQQLQFSLDPEPIAINCTAFNHNGNLLVTGAADGVIRLFDMQQHECAMSWRAHYGEVYSVEFSYDENTVYSIGEDGKFIQWNIHKSGLKVSEYSLPSDATGPFVLSGYSGYKQVQVPRGRLFAFDSEGNYMLTCSATGGVIYKLGGDEKVLESCLSLGGHRAPVVTVDWSTAMDCGTCLTASMDGKIKLTTLLAHKA

SEQ ID NO: 742459 - protein, 150 aa, Homo sapiens [sequence omitted]

SEQ ID NO: 742460 - protein, 588 aa, Homo sapiens
MAEAVERTDELVREYLLFRGFTHTLRQLDAEIKADKEKGFRVDKIVDQLQQLMQVYDLAALRDYWSYLERRLFSRLEDIYRPTIHKLKTSLFRFYLVYTIQTNRNDKAQEFFAKQATELQNQAEWKDWFVLPFLPSPDTNPTFATYFSRQWADTFIVSLHNFLSVLFQCMPVPVILNFDAECQRTNQVQEENEVLRQKLFALQAEIHRLKKEEQQPEEEEALVQHKLPPYVSNMDRLGDSELAMVCSQRNASLSQSLRVGFLSSLLPQSKKSPSRLSPAQGPPQPQSSAKKESFGGQGTKGKDPTSGAKDGKSLLSGLATGESGWSQHRQRRLQDHGKERKELFSTTTSQCAEKKPEASGPEAEPCPELHTEPVEPLTRASSAGPEGGGVRPEQPFIVLGQEEYGEHHSSIMHCRVDCSGRRVASLDVDGVIKVWSFNPIMQTKASSISKSPLLSLEWATKRDRLLLLGSGVGTVRLYDTEAKKNLCEININDNMPRIQPQDQSAPSLCGQAEGLTQAHVCCRILSLACSPNGASFVCSAAAPSLTSQVDFSAPDIGSKGMNQVPGRLLLWDTKTMKQQAGTGLPCGS

SEQ ID NO: 742461 - protein, 77 aa, Homo sapiens
TSEYNSMHLTPLDSMSDKPQGGYIRQHQILAGRKLIDKFCGGQSSRALKSTAIRGRWCSRHTSREEPNLDGQFDLPG

SEQ ID NO: 742462 - protein, 119 aa, Homo sapiens
RLALFFVKSSMHLARCRWASAPPLYTLIDVLKYSYVRLVCKDVRAPSRPAVETETRRSESGTASNTHITQKPRTLELARSSKKLRPNLKPINRTQFQCNKCLLSTYYVHALHWTFRIRD

SEQ ID NO: 742463 - protein, 69 aa, Homo sapiens
CGTLARVLRAQEGVGTCFFCTHTSPVASASSWALRGGPEGRGCQFKKEDTVLALRESLHSEGLPITHMI

SEQ ID NO: 742464 - protein, 35 aa, Homo sapiens
MGFPLAQSRSQTAIQEPRLGFMDPKTPLGVLSYGG

SEQ ID NO: 742465 - protein, 313 aa, Homo sapiens
TRSRSRSAGRRGRRRQSQSGSRSRSRSHGRRNRRRREDEGRRRRRRRSRERRSDSEEERWQRSGMRSRSPPRPKWHSRDGSSQSDSGEEQSRGQWARRRRRARSWSPSSSASSSASPGRSQSPRAAAAALSQQQSLQERLRLREERKQQEELMKAFETPEEKRARRLAKKEAKERKKREKMGWGEEYMGYTNTDNPFGDNNLLGTFIWNKALEKKGISHLEEKELKERNKRIQEDNRLELQKVKQLRLEREREKAMREQELEMLQREKEAEHFKTWEEQEDNFHLQQAKLRSKIRIRDGRAKPIDLLAKYISA

SEQ ID NO: 742466 - protein, 131 aa, Homo sapiens
TTVGPRGCKSGPAKVPFPSPSPSPHTRAATPGLALMLAQATPNGKGSIVNSDFLKGQRGDMLGAGCTFVILKYLLKFFSMKHKFELLKSHLSKFFFFFRQGLTLSPIPECSEPRFATALQPGQRNETVPPP

SEQ ID NO: 742467 - protein, 125 aa, Homo sapiens
TPNTHQERHTGVPQTRTQHRTKVAEKPQKRAVAGKHNQELPHCPHLSRGTWSQVCPLNLVHTRCSQHAALVSLSTPSCHLTGTDNRPSGFAAESKPQARCGLMPVIPVLWEAKARGSLEARSLRL

SEQ ID NO: 742468 - protein, 224 aa, Homo sapiens
MSETAPAETATPAPVEKSPAKKKATKKAAGAGAAKRKATGPPVSELITKAVAASKERNGLSLAALKKALAAGGYDVEKNNSRIKLGLKSLVSKGTLVQTKGTGASGSFKLNKKAASGEAKPKAKKAGAAKAKKPAGATPKKAKKAAGAKKAVKKTPKKAKKPAAAGVKKVAKSPKKAKAAAKPKKATKSPAKPKAVKPKAAKPKAAKPKAAKPKAAKAKKAAAK

SEQ ID NO: 742469 - protein, 131 aa, Homo sapiens
MSETAPAETATPAPVEKSPAKKKATKKAAGAGAAKRKATGPPVSELITKAVAASKERNGLSLAALKKALAAGGYDVEKNNSRIKLGLKSLVISSETGGPVALCAVVRRQSHYARRVGDGASDAAADKYACC

SEQ ID NO: 742470 - protein, 130 aa, Homo sapiens
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAKGK

SEQ ID NO: 742471 - protein, 713 aa, Homo sapiens
MRYVKACFLIMNLNEAEESEIISFGLMFNQKLIFTALVHSREPVTEVFECMIVFQNQFKITRSVTLEKMTIRLYRNRYFFRGFTLENLKKKFLFCHSCVILSAYENGISSLINPKLFYSEGEYTFRMNTGMCLKYSLEMLVAFQRAVLCLIEWWIHWLECVFSFLIDTKPTYFENLLCKCSVQIRDLSQKQEGPGHSHSLHKKEKKVDILGTFILASYLATYACQVRQKDNQTFFLQDIKDEKGLGDDQIQSLYFLKKLRLGIIDLTDRNCWKILVLLLTCCETILKIDIISCFNYPRLQKEAFQDKPICIWGNKSEAQLTEDNRKSNNIKMSPEDKALDLRFGSWKNSWKLSKIVYNQAHMKWSAVASYCAEEVEALRPKCWQMAWIWNNEEERPRANPKVMTGSWWVSQREVTSGKEHRERMEAEESCKLKSSDFGNKMSLPVCLNKVLESKPTFSCSQCIYQDENILTHRKMHIIHRYNTLHKNITHHIVQILICLVLGIQKYLLNEMKTPSSATYLINHKKNCVVSKMDMVIHTSWSEIIYMKYPEHIKHLINNSCYCCFKYGSNIVVNAYKNLKFIPQKTFSMSCEKYVMFCILKRKMCLNNQIKCLIHIILTVYEINSSIINMLVISKTNVVVYHFLAHLGCTNMWVCYNVRNAGSYMRFQPSIFPSVKELMNQEPNKKHSTLSDNLSTNLQSCQACYMITNCSMLL

SEQ ID NO: 742472 - protein, 81 aa, Homo sapiens
WAFRHRRAKLRLQQQQRQREINLLAYHGACHGAGPFPTGSLLDLRLLSTFKPPAYEDVVHRPGTTPRPPPPCLILSPQAAP

SEQ ID NO: 742473 - protein, 125 aa, Homo sapiens
GLGRGRCVCDFVSVSFCVCLRSAVPGGASVSCSAGWLHAWCWGLLSSCCATLWAVSAMPAFLVASLFLSHLSLSLFCVSFHTWSLPSRLVHAASSVLTPPAAAHSLPAVVMPSTLSLAEGILKTA

SEQ ID NO: 742474 - protein, 142 aa, Homo sapiens
PRRFYVCPAVLGSQRFSSGRHYWEVEVGNKPKWILGVCQDCLLRNWQDQPSVLGGFWAIGRYMKSGYVASGPKTTQLLPVVKPSKIGIFLDYELGDLSFYNMNDRSILYTFNDCFTEAVWPYFYTGTDSEPLKICSVSDSER

SEQ ID NO: 742475 - protein, 110 aa, Homo sapiens
LKSHCKLAHLCGVLSILQSFLAFPVQFSFHIFERPRPGSWLCYLETRRWGGFTGSTAAGFGGRRGSSGLGVLNVSARAALLVRCAWYPVCITLLTPSRTLAVHSDSEVSP

SEQ ID NO: 742476 - protein, 48 aa, Homo sapiens
MQNLRTWPSLGGVLGKQEVFRPDCLQISAMGSLVSHLRGIGNMDAAPE

SEQ ID NO: 742477 - protein, 816 aa, Homo sapiens
MAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 742478 - protein, 902 aa, Homo sapiens
MERLGTPSGLDSTKMESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 742479 - protein, 971 aa, Homo sapiens
MAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMARYCQPPPWPAGPGAVWQCPVGAGAEWQSGERSSTKDCNRGPDGAPRSLESGPPQVSWAPFFSTDLSDIFSREGRELSTRLPPVSTFTGKGSPVSLPSQVRGESLGKGHLFIAPDLSCFSPQSCPTRPLPRRHFPVGEPTRGMALQSAPRVRGGRGCRGAVPSCRPRVTLPLSPHSLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQRWYRSVTWAGVQWRDHSSL

SEQ ID NO: 742480 - protein, 157 aa, Homo sapiens
MGTPSLAASLGLQEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQRWYRSVTWAGVQWRDHSSL

SEQ ID NO: 742481 - protein, 816 aa, Homo sapiens; identical to SEQ ID NO: 742477

SEQ ID NO: 742482 - protein, 816 aa, Homo sapiens; identical to SEQ ID NO: 742477

SEQ ID NO: 742483 - protein, 816 aa, Homo sapiens; identical to SEQ ID NO: 742477

SEQ ID NO: 742484 - protein, 816 aa, Homo sapiens; identical to SEQ ID NO: 742477

SEQ ID NO: 742485 - protein, 671 aa, Homo sapiens
MAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTEKSNKFHPEDKYSTGPRPATFRNSSTP

SEQ ID NO: 742486 - protein, 220 aa, Homo sapiens [sequence omitted]

SEQ ID NO: 742487 - protein, 224 aa, Homo sapiens
IPAVTQPFHSSGATHLCQHLEFFFFWGCLMLAGSVRGLERGEGLPRPEWALPLQPPVPGMQDDGWAAGADGAPCLPPTDLGAGGAVCRGHRGVGTADVPCAGDPSTALHFPGGLSVLRWRPAVRPGWGAGQSLSWHGLTSGPVGQELVSQLVMRSTLHAGGVHADSLSLCHSIHAQEKAVFLPQCRFAASGSRAFSHLIRSLPELLPRSRHVIYPNAGSSAASM

SEQ ID NO: 742488 - protein, 748 aa, Homo sapiens
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 742489 - protein, 797 aa, Homo sapiens [sequence omitted]

SEQ ID NO: 742490 - protein, 242 aa, Homo sapiens
FLTAEGALATPLDDWIQNQGSLYPSEGWESGKFKEWNKEISNARHFVTRGASFLSSISHNQPQITVGSAKSRGHGAACVDGDLPCMGTPSLAASLGLQEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQRWYRSVTWAGVQWRDHSSL

SEQ ID NO: 742491 - protein, 816 aa, Homo sapiens; identical to SEQ ID NO: 742477

SEQ ID NO: 742492 - protein, 816 aa, Homo sapiens; identical to SEQ ID NO: 742477

SEQ ID NO: 742493 - protein, 714 aa, Homo sapiens
MAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEGLCRDDALGI

SEQ ID NO: 742494 - protein, 455 aa, Homo sapiens [sequence omitted]

SEQ ID NO: 742495 - protein, 112 aa, Homo sapiens
VCEEPGPWSSLCRRGPALHGHPLTGCFPWSPGRRHLSDLPLEPPLLHDLLHCDHGRSRTTERSLSFVFHITSCPCSSACSVREWGWVPSGRTLLGVGCAATDTYPPSSPASA

SEQ ID NO: 742496 - protein, 265 aa, Homo sapiens
AWLRRCFRSVGRRASLREISSSDSRASASRVAGITGIWKLFFRKKPISLELENSFASDTKMKEPLLGGECDKAVASQLGLLDEIKTEPDNAQEYCHRQQSRTQENELKINAVFSESASQLTAGIQLSLASSGMNKMLPSVSTTAIQVSCAGCKKILQKGQTAYQRKGSAQLFCSIPCITEYISSASSPVPSKRTCSNCSKDILNPKDVISVQLEDTTSCKTFCSLSCLSSYEEKRKPFVTICTNSILTKCSMCQKTAIIQYEVKY

SEQ ID NO: 742497 - protein, 271 aa, Homo sapiens
RHSLTLSPRLECSGSMSIHCDLHLPGSSDSRASASRVAGITGIWKLFFRKKPISLELENSFASDTKMKEPLLGGECDKAVASQLGLLDEIKTEPDNAQEYCHRQQSRTQENELKINAVFSESASQLTAGIQLSLASSGMNKMLPSVSTTAIQVSCAGCKKILQKGQTAYQRKGSAQLFCSIPCITEYISSASSPVPSKRTCSNCSKDILNPKDVISVQLEDTTSCKTFCSLSCLSSYEEKRKPFVTICTNSILTKCSMCQKTAIIQYEVKY

SEQ ID NO: 742498 - protein, 151 aa, Homo sapiens
VSNSLTAKQEHNPSLCLRGQINYFLESLIFFKMTMYKSKRRHQRYINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKCK

SEQ ID NO: 742499 - protein, 250 aa, Homo sapiens
VSNSLTAKQEHNPSLCLRGQINYFLESLIFFKMTMYKSKRRHQRYINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 742500 - protein, 395 aa, Homo sapiens
RRELPLPLLPPLVLPLSGARLPVAAAAASPARVGLRGLPPSQPRSFPAACKSAWLRVTCQCLRQRLREKNALHSFFHRHTVFYTKSHFYSNILLPLGLKQGEPIMTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 742501 - protein, 304 aa, Homo sapiens
MSKRRRLKQGEPIMTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 742502 - protein, 250 aa, Homo sapiens; identical to SEQ ID NO: 742499

SEQ ID NO: 742503 - protein, 196 aa, Homo sapiens
MGSEQSSEAESRPNDLNSSVTPSPAKHRAKMDDIVVVAQGSQASRNVSNDPDVIKLQEIPTFQPLLKGLLSGQTSPTNAKLEKLDSQQVLQLCLRYQDHLHQCAEAVAFDQNALVKRIKEMDLSVETLFSFMQERQKRYAKYAEQIQKVNEMSAILRRIQMGIDQTVPLLDRLNSMLPEGERLEPFSMKPDRELRL

SEQ ID NO: 742504 - protein, 153 aa, Homo sapiens
QNIEPGTVPSQFSSKGGSGTTVDKAVSLKGFLALGASCKTCQLPLDLRDCVPHRLDTRPCGEDLIKQGIMYFSFPSKMDLSVETLFSFMQERQKRYAKYAEQIQKVNEMSAILRRIQMGIDQTVPLLDRLNSMLPEGERLEPFSMKPDRELRL

SEQ ID NO: 742505 - protein, 153 aa, Homo sapiens; identical to SEQ ID NO: 742504

SEQ ID NO: 742506 - protein, 121 aa, Homo sapiens
MGSEQSSEAESRPNDLNSSVTPSPAKHRAKMDDIVVVAQGSQASRNVSNDPDVIKLQEIPTFQPLLKGLLSGQTSPTNAKLEKLDSQQVLQLCLRYQDHLHQCAEAVAFDQNALVKRIKER

SEQ ID NO: 742507 - protein, 196 aa, Homo sapiens; identical to SEQ ID NO: 742503

SEQ ID NO: 742508 - protein, 196 aa, Homo sapiens; identical to SEQ ID NO: 742503

SEQ ID NO: 742509 - protein, 148 aa, Homo sapiens
MGSEQSSEAESRPNDLNSSGLLSGQTSPTNAKLEKLDSQQVLQLCLRYQDHLHQCAEAVAFDQNALVKRIKEMDLSVETLFSFMQERQKRYAKYAEQIQKVNEMSAILRRIQMGIDQTVPLLDRLNSMLPEGERLEPFSMKPDRELRL

SEQ ID NO: 742510 - protein, 368 aa, Homo sapiens
MPSSQNTQVLPQSIPAPPSGCGSSIENLVSSLGLWLFPEVIRHLPCIVVLPQSILSRPPTTYPKASRINRRTTQAPPPGPPRLLPCSGSTPGPPRLLPQALAPPQGHPGFSSRFWFHPRTTQAPPPGPPRPLPQALVPPQDHPGSSPRTTQAPPLLWLHPRTTQTPPPGPPRPLPQALAPLQDHPDSSPRTTQDPPPGSGSTPGSPRLLPQALAPPQDHPGSSPRLWLLPRTTQAPPQALVPPQNHQGSSPRGSQARTSPNVVQMCRTFIKMEPALSLPPRNPESWLGDGGIEADCCLAGGALERTAAASTSSGSAFWMCMKRKWSSSQPHLTRSFSGLRGAADRSPTSSPTLARASATYLLSSTGET

SEQ ID NO: 742511 - protein, 368 aa, Homo sapiens; identical to SEQ ID NO: 742510

SEQ ID NO: 742512 - protein, 334 aa, Homo sapiens
ATPRERTDRPDRRSRGPLGHADHGEPLDCLPEQSGKGKLSPPLPPPSSPPGLWLLEMGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDVSSWVGHYGALVTHSSVRVRIRLS

SEQ ID NO: 742513 - protein, 291 aa, Homo sapiens
ATPRERTDRPDRRSRGPLGHADHGEPLDCLPEQSGKGKLSPPLPPPSSPPGLWLLEMGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVGPD

SEQ ID NO: 742514 - protein, 242 aa, Homo sapiens
ATPRERTDRPDRRSRGPLGHADHGEPLDCLPEQSGKGKLSPPLPPPSSPPGLWLLEMGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADW

SEQ ID NO: 742515 - protein, 1401 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRVGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 742516 - protein, 1367 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRVGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 742517 - protein, 1337 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRVGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNSISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 742518 - protein, 273 aa, Homo sapiens [sequence omitted]

SEQ ID NO: 742519 - protein, 704 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRVGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGLPRAPRSWERGLEQLLTQKKPTLHDGW

SEQ ID NO: 742520 - protein, 38 aa, Homo sapiens
HNRTNLTSSAEEPWKNQLSNSTQVIGGLASLLAFHINV

SEQ ID NO: 742521 - protein, 98 aa, Homo sapiens
LLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 742522 - protein, 207 aa, Homo sapiens
NQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATRPHRLMSRAAAAWNPA

SEQ ID NO: 742523 - protein, 233 aa, Homo sapiens
LVRLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYEAPPSYEQSCGGVEPSLTPES

SEQ ID NO: 742524 - protein, 107 aa, Homo sapiens
HPKETFRHDGQTPLTWTQHETDDKKERHMTLQEWTDTLTLNNPLHPPLCISTGATVPYFAEGSGGPVPTTSTLILPPEYSSWGYPYEAPPSYEQSCGGVEPSLTPES

SEQ ID NO: 742525 - protein, 107 aa, Homo sapiens
KVTQYALGSWVTSYVPLEARAKRPSRHGVKRGLGREVAEEAPGGGLLFPSFSGPGILGSRVGSPGLTLAPVTQSTERLTCCCASDMVVGTLEIPAALQTASLSTRIL

SEQ ID NO: 742526 - protein, 272 aa, Homo sapiens
MVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEEK

SEQ ID NO: 742527 - protein, 347 aa, Homo sapiens
MLLGSVGDALGYRNVCKENSTVGMKIQEELQRSGGLDHLVLSPGEWPVSDNTIMHIATAEALTTDYWCLDDLYREMVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEEK

SEQ ID NO: 742528 - protein, 103 aa, Homo sapiens
MRTVLFKLSAHTSLSQVGLLFHLRVSIRGSINIFPFKFYRMCFTIESRTAFGFTWLCGMRYEDRCIQVYRLYFTAESDCRQICMTDCCIRFLRVRHYPVYFFH

SEQ ID NO: 742529 - protein, 103 aa, Homo sapiens
MRTVLFKLSAHTSLSQVGLLFHLRVSIRGSINIFPFKFDRMCFTIESRTAFGFTWLCGMRYEDRCIQVYRLYFTAESDCRQICMTDCCIRFLRVRHYPVYFFH

SEQ ID NO: 742530 - protein, 103 aa, Homo sapiens; identical to SEQ ID NO: 742529

SEQ ID NO: 742531 - protein, 103 aa, Homo sapiens [sequence omitted]

SEQ ID NO: 742532 - protein, 1417 aa, Homo sapiens
MSPLLFLTWCSSSFLLWIYQFCSSFPKAPGFGFTGFAVCLLSHGSLRPALRTFREFNWCLERNASLPNPCIREEGREIYHLSFPFRKLEKVSVTCCGPAAGAADVCHFSRLRAGVGAAQPALLVRVSREAGVSRGLSCSPLKFNWAWGSASKVLTWLLIRERVRCDAQSFETVKPRPAACRRICFGKCETVHLRRMYFELLGTLFCVCQVTLTNPVAQSSCTLTADLSLVSQLLREACEQFYAMIMNMCFLLSYVSFCYTCFGAILSDAYKFRIVLSSCRTDLVIIMNYFSSPLLFTSCLLWILSDTNPGTLLLFVVSVFIMHLLPSFYCTGFKAHLIETSYTRDSFSFSSCQFCVSVTVFGPHIEGACAYGGFRAHLMFLFPLFFFCCFLIVINFFIYISCIRVLVISFNIILLGVALEISYMPLSSLAFPEGANDPEKVPPICQFPAIDAVALVRLPSTGKHARHRYRVPQRCLDSLFLDISVCFTLPIPMLFFLQLHAPMRADFHLAKNFFLSISLYHGYALTGRKFSQLLFAENKFSSPLFCTGQNSRWMIFAIPRTLKMGSTVFWLPCVLLKIQCSGRVLWLTPVIPALWEAEASGSRGQEIETILANTVKPRLYKKYKKLAGRGGPVVAATQEAEAGEWREPRRRSLQEPRSRHCTPAWATERDSVSKKKKKDSMFIVICCSFEGNGSFFFVLKLFLLIFGFQQSVLCLDVIFFLRIFLGIYRTQIWELASFISFGKFLAIFFFFTIFSPVLPLLPETSVLCVCAHVCMHSCVRVCACVRPCVCAYVSVCGCNLHVSSVMCSIFHSSLYIRLDASCLRGFRFTESCLLLCPTEKPMRFFNIKNSSFDDREKNTNIDDCTIALRRNIPGPEQRVFSSAESGFLVSLRECMVSDAILLFSSISTHLRVLGECVVSDPILLLSRVSGHLRVLRECVVLDAILLISSISSHLRVLGECVVSDPILLISSISSHLCVLGECVVSDPILLLSSISSHLRVLGECVVSDPILLLSRVSSHLRVLGECVVSDPILLLSRVSSHLRVLRECVVLDAILLISSISSHLRVLGECVVSDPILLLSSISSHLRALGECVVSDPILLLSRVSSHLRVLVLISAGIPHLLVHAIHLFHQILLHHHYNDFFLISVFFQFEISDVVFFRSKVSGEFFVDADSLLKFSIFSFPLYLFSSFFYNILHFSNKFLVSVQHCISGPLNKSLNYKGPLISGFLKKYILQKFLEICNNLKNFADEPHSLEISEEKKKLCHECIKYTDHTWTIHSREKCRRKDAALAELQWLTPVIPALWEAEVGRSPKVRSSRPAWPTWRNPVTTKNKKLARHGGTCLELQLLGRLRQENHLNPEGRGCSEPRSRHCTPAWATRAKLCLKKKKNAALNYNCMKLTAVHSVLLEELQSHLLLLLQ

SEQ ID NO: 742533 - protein, 1455 aa, Homo sapiens
MSPLLFLTWCSSSFLLWIYQFCSSFPKAPGFGFTGFAVCLLSHGSLRPALRTFREFNWCLERNASLPNPCIREEGREIYHLSFPFRKLEKVSVTCCGPAAGAADVCHFSRLRAGVGAAQPALLVRVSREAGVSRGLSCSPLKFNWAWGSASKVLTWLLIRERVRCDAQSFETVKPRPAACRRICFGKCETVHLRRMYFELLGTLFCVCQVTLTNPVAQSSCTLTADLSLVSQLLREACEQFYAMIMNMCFLLSYVSFCYTCFGAILSDAYKFRIVLSSCRTDLVIIMNYFSSPLLFTSCLLWILSDTNPGTLLLFVVSVFIMHLLPSFYCTGFKAHLIETSYTRDSFSFSSCQFCVSVTVFGPHIEGACAYGGFRAHLMFLFPLFFFCCFLIVINFFIYISCIRVLVISFNIILLGVALEISYMPLSSLAFPECANDPEKVPPICQFPAIDAVALVRLPSTGKHARHRYRVPQRCLDSLFLDISVCFTLPIPMLFFLQLHAPMRADFHLAKNFFLSISLYHGYALTGRKFSQLLFAENKFSSPLFCTGQNSRWMIFAIPRTLKMGSTVFWLPCVLLKIQCSGRVLWLTPVIPALWEAEASGSRGQEIETILANTVKPRLYKKYKKLAGRGGPVVAATQEAEAGEWRETQETELAVSRDRATALQPGRQSETPSQKKKKKDSMFIVICCSFEGNGSFFFVLKLFLLIFGFQQSVLCLDVIFFLRIFLGIYRTQIWELASFISFGKFLAIFFFFTIFSPVLPLLPETSVLCVCAHVCMHSCVRVCACVRPCVCAYVSVCGCNLHVSSVMCSIFHSSLYIRLDASCLRGFRFTESCLLLCPTEKPMRFFNIKNSSFYDREKNTNIDDCTIALRRNIPGPEQRVFSSAESGFLVSLRECMVSDAILLFSSISTHLRVLGECVVSDPILLLSRVSGHLRVLRECVVLDAILLISSISSHLRVLGECVVSDPILLISSISSHLCVLGECVVSDPILLLSSISSHLRVLGECVVSDPILLLSRVSSHLRVLGECVVSDPILLLSRVSSHLRVLRECVVLDAILLISSISSHLRVLGECVVSDPILLLSSISSHLRALGECVVSDPILLLSRVSSHLRVLVLISAGIPHLLVHAIHLFHQILLHHHYNDFFLISVFFQFEISDVVFFRSKVSGEFFVDADSLLKFSIFSFPLYLFSSFFYNILHFSNKFLVSVQHCISGPLNKSLNYKGPLISGFLKKYILQKFLEICNNLKNFADEPHSLEISEEKKKLCHECIKYTDHTWTIHSREKCRRKDAALAELQWLTPVIPALWEAEVGRSPKVRSSRPAWPTWRNPVTTKNKKLARHGGTCLELQLLGRLRQENHLNPEGRGCSEPRSRHCTPAWATRAKLCLKKKKNAALNYNCMKLTAVHSVLLEIITKPPPVAIAVSASMSRIRLKHRVVLISARAVHVFSTLCITVKSDLF

SEQ ID NO: 742534 - protein, 1455 aa, Homo sapiens; identical to SEQ ID NO: 742533

SEQ ID NO: 742535 - protein, 1456 aa, Homo sapiens
MSPLLFLTWCSSSFLLWIYQFCSSFPKAPGFGFTGFAVCLLSHGSLRPALRTFREFNWCLERNASLPNPCIREEGREIYHLSFPFRKLEKVSVTCCGPAAGAADVCHFSRLRAGVGAAQPALLVRVSREAGVSRGLSCSPLKFNWAWGSASKVLTWLLIRERVRCDAQSFETVKPRPAACRRICFGKCETVHLRRMYFELLGTLFCVCQVTLTNPVAQSSCTLTADLSLVSQLLREACEQFYAMIMNMCFLLSYVSFCYTCFGAILSDAYKFRIVLSSCRTDLVIIMNYFSSPLLFTSCLLWILSDTNPGTLLLFVVSVFIMHLLPSFYCTGFKAHLIETSYTRDSFSFSSCQFCVSVTVFGPHIYGACAYGGFRAHLMFLFPLFFFCCFLIVINFFIYISCIRVLVISFNIILLGVALEISYMPLSSLAFPEGANDPEKVPPICQFPAIDAVALVRLPSTGKHARHRYRVPQRCLDSLFLDISVCFTLPIPMLFLPAASCSNEELIFIELNNFFLSISLYHGYALTGRKFSQLLFAENKFSSPLFCTGQNSRWMIFAIPRTLKMGSTVFWLPCVLLKIQCSGRVLWLTPVIPALWEAEASGSRGQEIETILANTVKPRLYKKYKKLAGRGRPVVAATQEAEAGEWRETQETELAVSRDRATALQPGRQSETPSQKKKKKIQMFIVICCSFEGNGSFFFVLKLFLLIFGFQQSVLCLDVIFFLRIFLGIYRTQIWELASFISFGKFLAIFFFFTIFSPVLPLLPETSVLCVCAHVCMHSCVRVCACVRPCVCAYVSVCGCNLHVSSVMCSIFHSSLYIRLDASCLRGFRFTESCLLLCPTEKPMRFFNIKNSSFDDREKNTNIDDCTIALRRNIPGPEQRVFSSAESGFLVSLRECMVSDAILLFSSISTHLRVLGECVVSDPILLLSRVSGHLRVLRECVVLDAILLISSISSHLRVLGECVVSDPILLISSISSHLCVLGECVVSDPILLLSSISSHLRVLGECVVSDPILLLSRVSSHLRVLGECVVSDPILLLSRVSSHLRVLRECVVLDAILLISSISSHLRVLGECVVSDPILLLSSISSHLRALGECVVSDPILLLSRVSSHLRVLVLISAGIPHLLVHAIHLFHYILLHHHYNDFFLISVFFQFLISDVVFFRSKVSGEFFVDADSLLKFSIFSFPLYLFSSFFYNILHFSNKFLVSVQHCISGPLNKSLNYKGPLISGFLKKYILQKFLEICNNLKNFADEPHSLEISEEKKKLCHECIKYTDHTWTIHSREKCRRKDAALAECSGYTPVIPALWEAEVGRSPKVRSSRPAWPTWRNPVTTKNKKLARHGGYMPVTPATWEAEAGESLEPGRQRLQWAEITPLHSSLGNKSKTLSQKKKNAALNYNCMKLTAVHSVLLEIITKPPPVAIAVSASMSRIRLKHRVVLISARAVHVFSTLCITVKSDLF

SEQ ID NO: 742536 - protein, 530 aa, Homo sapiens
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERAQRMRKRKEELSKLLPPRRSMVASKIPSATDLTDNRKVPLNPPGKMKPSKEKSPQASKEMSALQERNLEEKIKQHVLQMREQRRFHGQAPLEEMRKAAEDLEIATELQDEVLKLKLGLTLNKDRRRAALTGNLSLGLPAAQPQNTFFNTKYGESGNVRRYQ

SEQ ID NO: 742537 - protein, 473 aa, Homo sapiens
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERAQRMRKRKEELSKLLPPRRSMVASKIPSATDLTDNRKVPLNPPGKMKPSKEKSPQASKEMSALQERNLEEKIKQHVLQMREQRRFHGQAPLEEMRKAAEDLEIP

SEQ ID NO: 742538 - protein, 79 aa, Homo sapiens
KTLGKGQTGLVKLGVHCITGQKVAIKIVNREKLSESVLMKVEREIAILKLIEHPHVLKLHDVYENKKYLVPGSGARLGG

SEQ ID NO: 742539 - protein, 741 aa, Homo sapiens
KTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 742540 - protein, 744 aa, Homo sapiens
KTLGKGQTGLVKLGVHCITGQKVAIKIVNREKLSESVLMKVEREIAILKLIEHPHVLKLHDVYENKKYLVSPHGKLSARRSWDLLSGFPRYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPDCFYFIY

SEQ ID NO: 742541 - protein, 757 aa, Homo sapiens
LDTPTMGRLRRSESLSQSQSPARKDGGGGPAVQTPENGPLCPNSGDPKDSWAGKPERGQPSCSPPAPSPPDELTSGPSMLAQVSPHGKLSARRSWDLLSGFPRYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPDCFYFIY

SEQ ID NO: 742542 - protein, 455 aa, Homo sapiens
MRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPDCFYFIY

SEQ ID NO: 742543 - protein, 183 aa, Homo sapiens
MQYDLKLLRHHLQIPIHFPKDFLSVMLEKGSLSAMRFLTAVNLEHPEMLEKASRELWMRVWSRNEDITEPQSIMAAAEKAGMSAEQAQGLLEKIATPKVKNQLKETTEAACRYGAFGLPITVAHVDGQTHMLFGSDRMELVAHLLGEKWMGPIPPTFTSMPHKCLSESPNSAFPQNKPNAIRQ

SEQ ID NO: 742544 - protein, 1332 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 742545 - protein, 1279 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQEDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 742546 - protein, 773 aa, Homo sapiens
MGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 742547 - protein, 662 aa, Homo sapiens
MRLLPSALPTCLISGTLYSMYSSKQAEAQRRYNGHRDTTGGTADGTASLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 742548 - protein, 285 aa, Homo sapiens
MRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 742549 - protein, 112 aa, Homo sapiens
MFRMLQALEREPMNLASQMNKPGMQESADKPTRRENPHKYLLYKPTFSQLYTFLAASFKELPANSVLLIYLSATGVFPTGRSDSEGPYDFGGVLTNSNRDIINGDAIHKRNQ

SEQ ID NO: 742550 - protein, 416 aa, Homo sapiens
MGPYPGYRDQKRSVFLLTLGLHLLVGDFLGFRPCHLLHFGEQDLSVSGTGGPGFCTGEAECGEQALSPQLPVSPAPQVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 742551 - protein, 616 aa, Homo sapiens
RRGRDAALRPSMAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 742552 - protein, 406 aa, Homo sapiens
NGRLVPAGDLGLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 742553 - protein, 348 aa, Homo sapiens
YDPNDYGEKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 742554 - protein, 742 aa, Homo sapiens
RRGRDAALRPSMAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRLRSEELAGDLPRDKGSCRPLSGPVIVRDPLPRLASLWTPLLEGRSHVCLIHGPQPLARGLAQKTGSLSLMNGCATHVWFSIEFHEYLLGPAWHSGKGPQRRGLGVERLPWWNRTVTLLPREEPVSRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 742555 - protein, 646 aa, Homo sapiens
RRGRDAALRPSMAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGTPTGGRGSLHSFLVTKPRGLSVAPLPPAYGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 742556 - protein, 504 aa, Homo sapiens
RRGRDAALRPSMAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEGLTADPAAVTH

SEQ ID NO: 742557 - protein, 137 aa, Homo sapiens
GEARWKAQSDEVAQLGKVSVLMAIRSMMGVTWSPRESGCSSLSHSVALNLPSRPQDMVYEEQLQLGRALQESLQLSTEPRGPGSPPRTPPAPGPPSFEEQLRLALELSSREQEERERRGQQEEEDLQRILQLSLTEH

SEQ ID NO: 742558 - protein, 274 aa, Homo sapiens
RRGRDAALRPSMAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERSVGSWHTVGGMGTDSKSHH

SEQ ID NO: 742559 - protein, 369 aa, Homo sapiens
RRGRDAALRPSMAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQR

SEQ ID NO: 742560 - protein, 283 aa, Homo sapiens
LSACSSECRHKPAEAVTMLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGSGGREEVGGQWWGGIEEQGDLSNFAPVQEQGSHIC

SEQ ID NO: 742561 - protein, 687 aa, Homo sapiens
LSACSSECRHKPAEAVTMLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGSGGREEVGGQWWGGIEEQGDLSNFAPVQEQGSHICYKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGSQPPRFCFQSKSWKRCVPVTLELTKVWRQADQTFISLLQAVRLGRCSDEVTRQLQATASHKVGRDGIVATRLCTHQDDVALTNERRLQELPGKVHRFEAMDSNPELASTLDAQCPVSQLLQLKLGAQVMLVKNLSVSRGLVNGARGVVVGFEAEGRGLPQVRFLCGVTEVIHADRWTVQATGGQLLSRQQLPLQLAWAMSIHKSQGMTLDCVEISLGRVFASGQAYVALSRARSLQGLRVLDFDPMAVRCDPRVLHFYATLRRGRSLSLESPDDDEAASDQENMDPIL

SEQ ID NO: 742562 - protein, 640 aa, Homo sapiens
LSACSSECRHKPAEAVTMLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGSGGREEVGGQWWGGIEEQGDLSNFAPVQEQGSHICYKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGSQPPRFCFQSKSWKRCVPVTLELTKVWRQADQTFISLLQAVRLGRKVHRFEAMDSNPELASTLDAQCPVSQLLQLKLGAQVMLVKNLSVSRGLVNGARGVVVGFEAEGRGLPQVRFLCGVTEVIHADRWTVQATGGQLLSRQQLPLQLAWAMSIHKSQGMTLDCVEISLGRVFASGQAYVALSRARSLQGLRVLDFDPMAVRCDPRVLHFYATLRRGRSLSLESPDDDEAASDQENMDPIL

SEQ ID NO: 742563 - protein, 498 aa, Homo sapiens
LSACSSECRHKPAEAVTMLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGSGGREEVGGQWWGGIEEQGDLSNFAPVQEQGSHICYKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGLDTELQSPEHPSFQAAEGRGNEDRCSGSSIRALGGDWWGLRLGAASKQRTELRCVSTARPSLAQPRTNTLQSLTKEHKLQNVHPYFKLLFQGINSVWGH

SEQ ID NO: 742564 - protein, 76 aa, Homo sapiens
GSVLAVSGSVCCFPRDIRRAQEYMSAHSFGVSQMMLYDTKCYRSQRLGKGNGSNRKPDGTKANMETMITAKSHPCI

SEQ ID NO: 742565 - protein, 35 aa, Homo sapiens
MQNALENLSNRIEQVEERNSELKDKVFELTQSNKD

SEQ ID NO: 742566 - protein, 74 aa, Homo sapiens
ATALLEPPGLPSHVAPSPVQPCPWLPWPRPLSIQGRQAQFPRASAWASLSQTSPWPSGPSQGMASSVRRTDHCI

SEQ ID NO: 742567 - protein, 85 aa, Homo sapiens
MPAVAVHTGHCCTKPQGQAARWPWLANVAHPVSRSSAWRDDCWKPGQTQSLHECGPGCGSRSTATTRAGAQGESPASSNPPLKKK

SEQ ID NO: 742568 - protein, 94 aa, Homo sapiens
PPSELNLLCSRSTPSGSVSSAKPNPLSKETFLEGNTELVNVMRGRTEQLRCRLCTYHNVDESHLMLGEKSQAQKSIYCVNLLTRSSRAGKTNLR

SEQ ID NO: 742569 - protein, 114 aa, Homo sapiens
APPGPTRLACGLWRIHSYPNPHPIPSLLLETPHCWMWDFRSSTSHGNWHFKQRQREGNTRKTKKLVHRTDVEFSCSDTSTPGADDQPHPCLHSEHINTAQLSSPCCHLPEPPVF

SEQ ID NO: 742570 - protein, 119 aa, Homo sapiens
SGAAGRKTRAARSGSGRLEKMVLRRLLAALLHSPQLVERLSESRPIRRAAQLTAFALLQAQLRGQDAARRLQDLAAGPVGSLCRRAERFRDAFTQELRRGLRGRSGPPPGSQRGPGANI

SEQ ID NO: 742571 - protein, 119 aa, Homo sapiens; identical to SEQ ID NO: 742570

SEQ ID NO: 742572 - protein, 112 aa, Homo sapiens
LRLVEAGLMAEEKMVLRRLLAALLHSPQLVERLSESRPIRRAAQLTAFALLQAQLRGQDAARRLQDLAAGPVGSLCRRAERFRDAFTQELRRGLRGRSGPPPGSQRGPGANI

SEQ ID NO: 742573 - protein, 128 aa, Homo sapiens
MTSLFAQEIRLSKRHEEIVSQRLMLLQQMENKLGDQHTEKASQLQTVETAFKRNLSLLKDIEAAEKSLQTRIHPLPRPEVVSLETRYWASVEEYIPKWEQFLLGRAPYPFAVENQNEAENTIQNEAQR

SEQ ID NO: 742574 - protein, 128 aa, Homo sapiens; identical to SEQ ID NO: 742573

SEQ ID NO: 742575 - protein, 128 aa, Homo sapiens; identical to SEQ ID NO: 742573

SEQ ID NO: 742576 - protein, 128 aa, Homo sapiens; identical to SEQ ID NO: 742573

SEQ ID NO: 742577 - protein, 128 aa, Homo sapiens; identical to SEQ ID NO: 742573

SEQ ID NO: 742578 - protein, 131 aa, Homo sapiens
NWWVLGLTDLRKKPRTLGNSWRAEACCIFIIALPPPNTIGGPALIISLQVYPAAPERQRPARRGHDDGGGFVKTKMGICREKKERSDCYCVYIEREDIRDSILKKTCTLNNCFAEMLLICSFAPATLPQPL

SEQ ID NO: 742579 - protein, 214 aa, Homo sapiens
KQYPVSLGSAAATLRETSGRAGAGSWRTVFGSGGGAMTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 742580 - protein, 172 aa, Homo sapiens
MINTFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYGKLPSMAVSPRSRNSYILSTDCSI

SEQ ID NO: 742581 - protein, 82 aa, Homo sapiens
KQYPVSLGSAAATLRETSGRAGAGSWRTVFGSGGGAMTTLRAFTCDDLFRFNNINLDPLTETYGIPFYLQYLAHWTAAYICF

SEQ ID NO: 742582 - protein, 214 aa, Homo sapiens; identical to SEQ ID NO: 742579

SEQ ID NO: 742583 - protein, 214 aa, Homo sapiens; identical to SEQ ID NO: 742579

SEQ ID NO: 742584 - protein, 214 aa, Homo sapiens; identical to SEQ ID NO: 742579

SEQ ID NO: 742585 - protein, 166 aa, Homo sapiens
MLSQSCNLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 742586 - protein, 176 aa, Homo sapiens
MINTFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 742587 - protein, 211 aa, Homo sapiens
KQYPVSLGSAAATLRETSGRAGAGSWRTVFGSGGGAMTTLRAFTCDDLFRFNNIPLQTLYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 742588 - protein, 201 aa, Homo sapiens
KQYPVSLGSAAATLRETSGRAGAGSWRTVFGSGGGAMTTLRAFTCDDLFRFNNINLDPLTETPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 742589 - protein, 78 aa, Homo sapiens
GLLALPYCLLVRGRAAPLLGRGHRRRPGRRGGLRGSEAGQQLLGCVHREAHLVAVVKLYPNEMTLITASPAADAVSVM

SEQ ID NO: 742590 - protein, 91 aa, Homo sapiens
TSNDYFSPNRAPESSNENNIVHKASRVSNQVAVNMYKQLGYSVYRTVIEYYSASNGEPDEDAYDMRKALSRDTEKKSIIPLPHPVRPEDIE

SEQ ID NO: 742591 - protein, 147 aa, Homo sapiens
KQYPVSLGSAAATLRETSGRAGAGSWRTVFGSGGGAMTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERYEESTFQGY

SEQ ID NO: 742592 - protein, 214 aa, Homo sapiens; identical to SEQ ID NO: 742579

SEQ ID NO: 742593 - protein, 210 aa, Homo sapiens
KQYPVSLGSAAATLRETSGRAGAGSWRTVFGSGGGAMTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYGKLPSMAVSPRSRNSYILSTDCSI

SEQ ID NO: 742594 - protein, 878 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742595 - protein, 904 aa, Homo sapiens
SASPPTSARFRKIRGVHAPGATLPPTPAPPSSHQTHAGAPSPYNWGAGILPGSRWGWEGAGRKRGPAGSLRFRGKQPALPWEGHSPPAAEGGSELFRRHIPLPPLQFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742596 - protein, 871 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEATYQWSDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742597 - protein, 621 aa, Homo sapiens
QTNRKPTLNFPTESILEATVLPRAPKNPHNEYFITITQFSFLKFTNIINILCNQEIHSRHILQYWNVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742598 - protein, 896 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRRPDGPSSFRAWRMAVSQPQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742599 - protein, 878 aa, Homo sapiens; identical to SEQ ID NO: 742594

SEQ ID NO: 742600 - protein, 514 aa, Homo sapiens
VGWGYGVGEVLELRRARGAPGTWSPKQLHGIGTGQESLAVHVTLQTSLQRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742601 - protein, 860 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742602 - protein, 349 aa, Homo sapiens
FPFAPLTCPVFTLEDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742603 - protein, 878 aa, Homo sapiens; identical to SEQ ID NO: 742594

SEQ ID NO: 742604 - protein, 145 aa, Homo sapiens
MWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742605 - protein, 250 aa, Homo sapiens
MDGFGGLAAEVGIWLSTIYLSYWAICSPQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 742606 - protein, 809 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGARAGRVHEGAKPPGKPTFSKLGSPFGPSFN

SEQ ID NO: 742607 - protein, 696 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVSYVPS

SEQ ID NO: 742608 - protein, 612 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGLGCPRTGISVGPVHHRTTTCRGWRSASVFSEVLCPRPAAALHSGSSQDPSNELF

SEQ ID NO: 742609 - protein, 487 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNGWDTWGVGWGELFPRPLPVSPAIKTDSSLAPWP

SEQ ID NO: 742610 - protein, 335 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEATYQWRCADGGGHRFQRG

SEQ ID NO: 742611 - protein, 373 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGAISARLTRAPSWMSQRTPVSSLAPTQRMRSTPVRRRKAREARPRAPWGTSP

SEQ ID NO: 742612 - protein, 727 aa, Homo sapiens
SAQWPSELFLLDRHTQLASSLSFPSTAGPKPAFQGAAMPYLYRAPGPQAHPVPKDARITHSSGQSFEQMRQECLQRGTLFEDADFPASNSSLFYSERPQIPFVWKRPGEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDSSPEWRSVGPAEQKRLCHTALDDGEFWMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 742613 - protein, 701 aa, Homo sapiens
SAQWPSELFLLDRHTQLASSLSFPSTAGPKPAFQGAAMPYLYRAPGPQAHPVPKDARITHSSGQSFEQMRQECLQRGTLFEDADFPASNSSLFYSERPQIPFVWKRPGEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDRMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 742614 - protein, 152 aa, Homo sapiens
TVLSFDDEVKGVCTPVTCTSHPRRQRMVLRLTPQEPSQTGVLFRIPSGLGYSESWVSSFVPTGFQLSSHLLQLIVLRYADEELQLDFDDFLNCLVRLENASRKCPARLRVHLGVASSVTLHERMRNSLVKVMAKIDHREPWSDVCGPMGLCG

SEQ ID NO: 742615 - protein, 669 aa, Homo sapiens
SAQWPSELFLLDRHTQLASSLSFPSTAGPKPAFQGAAMPYLYRAPGPQAHPVPKDARITHSSGQSFEQMRQECLQRGTLFEDADFPASNSSLFYSERPQIPFVWKRPGFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDRMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASLHPFDNEHLRLPCRDAACPAESWLLDLDLQNFSWCGTITPRVHSPLIVRPSPFILIWEE

SEQ ID NO: 742616 - protein, 661 aa, Homo sapiens
SAQWPSELFLLDRHTQLASSLSFPSTAGPKPAFQGAAMPYLYRAPGPQAHPVPKDARITHSSGQSFEQMRQECLQRGTLFEDADFPASNSSLFYSERPQIPFVWKRPGFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDRMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRKCPARLRVHLGVASSVTLHERMRNSLVKVMAKIDHREPWSDVCGPMGLCG

SEQ ID NO: 742617 - protein, 135 aa, Homo sapiens
PVVMGLLLHLLKNFVSSRRPLHVLSHGCAALRSCVHVCGVACVQPVMRRSGRVGGCPGKTDAPGSAPRSSATSPGGERRWGRFVICLRLSPAAVWPPWGKSFTLSVPQCLCEVGGSFWKIKWANTRQMLEHTGTW

SEQ ID NO: 742618 - protein, 319 aa, Homo sapiens
MAGRSDMDPPAAFSGFPALPAVAPSGPPPSPLAGAEPGREPEEAAAGRGEAAPTPAPGPGRRRRRPLQRGKPPYSYIALIAMALAHAPGRRLTLAAIYRFITERFAFYRDSPRKWQNSIRHNLTLNDCFVKVPREPGNPGKGNYWTLDPAAADMFDNGSFLRRRKRFKRAELPAHAAAAPGPPLPFPYAPYAPAPGPALLVPPPSAGPGPSPPARLFSVDSLVNLQPELAGLGAPEPPCCAAPDAAAAAFPPCAAAASPPLYSQVPDRLVLPATRPGPGPLPAEPLLALAGPAAALGPLSPGEAYLRQPGFASGLERYL

SEQ ID NO: 742619 - protein, 130 aa, Homo sapiens
MGVSRSARAPPDGELAGGGGSSSSSLGGTSLSQLRQGKRELRTLTPTHAHTQGSVGWEREGRFSFCSLGLPRAFPAAERDTSSQVKGHSGPGPDPVVTHLGTFPDQLRLPCPPLSRKEPEPSPLSHPPQG

SEQ ID NO: 742620 - protein, 130 aa, Homo sapiens; identical to SEQ ID NO: 742619

SEQ ID NO: 742621 - protein, 96 aa, Homo sapiens
GRRLNEAWDAGAAPRAVSAVPEVWEAPGEASLLQVMMMSDNAKGRAAHSWKKRGSISSLSNHEFWRKEIHGRIKDPGSLWITHTMPFTGGKLTIKE

SEQ ID NO: 742622 - protein, 214 aa, Homo sapiens
GRRLNEAWDAGAAPRAVSAVPEVWEAPGEASLLQVMMMSDNAKGRAAHSWKKRGSISSLSNHEFWRKEIHGRIKDSMSTVSYMEEPSQRDDISRLTVQMENTYQLGPPKHFPVVTVNHILKDVVTSYLQVEEYEPELCRQMTKTISEVIKAQVKDLMIPRYKLIVIVHIGQLNRQSILIGSRCLWDPKSDTFSSYVFRNSSLFALANVYAVYLE

SEQ ID NO: 742623 - protein, 214 aa, Homo sapiens; identical to SEQ ID NO: 742622

SEQ ID NO: 742624 - protein, 107 aa, Homo sapiens
GRRLNEAWDAGAAPRAVSAVPEVWEAPGEASLLQVMMMSDNAKGRAAHSWKKRGSISSLSNHEFWRKEIHGRIKDSMSTVSYMEEPSQRDDISRLTVQMENTYQLGY

SEQ ID NO: 742625 - protein, 43 aa, Homo sapiens
MGWEEREEWVLPALLASQLVNHSSDGQSLSSLALPGPEIPAGA

SEQ ID NO: 742626 - protein, 411 aa, Homo sapiens
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 742627 - protein, 411 aa, Homo sapiens; identical to SEQ ID NO: 742626

SEQ ID NO: 742628 - protein, 411 aa, Homo sapiens; identical to SEQ ID NO: 742626

SEQ ID NO: 742629 - protein, 536 aa, Homo sapiens
AGSHRPSWWWSRHHARCGVTRQSWKGEVQPQVKRQKLSLLRFLSAELTRGYFLEHNEAKYTERRERVYTCLRIPRELEKLMVFGIFLCLDAFLYVFTLLPLRVFLALFRLLTLPCYGLRDRRLLQPAQVCDILKGVILVICYFMMHYVDYSMMYHLIRGQSVIKLYIIYNMLEVADRLFSSFGQDILDALFGQQQSLKKETRAHIGVIPHFFMAVLYVFLHAILIMVQATTLNVAFNSHNKSLLTIMMSNNFVEIKGSVFKKFEKNNLFQMSNSDIKERFTNYVLLLIVCLRNMEQFSWNPDHLWVLFPDVCMVIASEIAVDIVKHAFITKFNDITADVYSEYRASLAFDLVSSRQKNAYTDYSDSVARRMGFIPLPLAVLLIRVVTSSIKVQGILSYACVILFYFGLISLKVLNSIVLLGKSCQYVKEAKMEEKLSNPPATCTPGKPSSKSQNKCKPSQGLSTEENLSASITKQPIHQKENIIPLLVTSNSDQFLTTPDGDEKDITQDNSELKHRSSKKDLLEIDRFTICGNRID

SEQ ID NO: 742630 - protein, 536 aa, Homo sapiens; identical to SEQ ID NO: 742629

SEQ ID NO: 742631 - protein, 536 aa, Homo sapiens; identical to SEQ ID NO: 742629

SEQ ID NO: 742632 - protein, 536 aa, Homo sapiens; identical to SEQ ID NO: 742629

SEQ ID NO: 742633 - protein, 536 aa, Homo sapiens; identical to SEQ ID NO: 742629

SEQ ID NO: 742634 - protein, 91 aa, Homo sapiens
QLGLSSTLHGQKGPLSLSTEENLSASITKQPIHQKENIIPLLVTSNSDQFLTTPDGDEKDITQDNSELKHRSSKKDLLEIDRFTICGNRID

SEQ ID NO: 742635 - protein, 333 aa, Homo sapiens
AGSHRPSWWWSRHHARCGVTRQSWKGEVQPQVKRQKLSLLRFLSAELTRGYFLEHNEAKYTERRERVYTCLRIPRELEKLMVFGIFLCLDAFLYVFTLLPLRVFLALFRLLTLPCYGLRDRRLLQPAQVCDILKGVILVICYFMMHYVDYSMMYHLIRGQSVIKLYIIYNMLEVADRLFSSFGQDILDALFGQQQSLKKETRAHIGVIPHFFMAVLYVFLHAILIMVQATTLNVAFNSHNKSLLTIMMSNNFVEIKGSVFKKFEKNNLFQMSNSDIKERFTNYVLLLIVCLRNMEQFSWNPGNSLLTKQCLIILLLSQNHSFTWNKMNIAENS

SEQ ID NO: 742636 - protein, 206 aa, Homo sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 742637 - protein, 206 aa, Homo sapiens; identical to SEQ ID NO: 742636

SEQ ID NO: 742638 - protein, 209 aa, Homo sapiens
ESSWWLLGPSSWTQECQPTDQALCSSLPTGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 742639 - protein, 206 aa, Homo sapiens; identical to SEQ ID NO: 742636

SEQ ID NO: 742640 - protein, 206 aa, Homo sapiens; identical to SEQ ID NO: 742636

SEQ ID NO: 742641 - protein, 206 aa, Homo sapiens; identical to SEQ ID NO: 742636

SEQ ID NO: 742642 - protein, 206 aa, Homo sapiens; identical to SEQ ID NO: 742636

SEQ ID NO: 742643 - protein, 206 aa, Homo sapiens; identical to SEQ ID NO: 742636

SEQ ID NO: 742644 - protein, 121 aa, Homo sapiens
VPHLHRESHTCTGSPTPAPESHTCTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 742645 - protein, 163 aa, Homo sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSGDQPLTGAYTVTLDGRGPSRVISKHDLGHFMLRCLTTDEYDGHSTYPSHQYQ

SEQ ID NO: 742646 - protein, 178 aa, Homo sapiens
IRMPPSQMGAESTAQQPVGSRVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 742647 - protein, 185 aa, Homo sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLNLDGRGPSRVISKHDLGHFMLRCLTTDEYDGHSTYPSHQYQ

SEQ ID NO: 742648 - protein, 94 aa, Homo sapiens
MAVKKIAIFGATGQTGLTTLAQAVQAGYEVTVLVRDSSRLPSEGPRPAHVVVGDVLQAADVDKTVAGQDAVIVLLGTRNDLSTEPPLCPRPSPT

SEQ ID NO: 742649 - protein, 98 aa, Homo sapiens
FLRHFSKLELSMSLVPFSPRFPFPRVKWFLAYFSRMSIAPSPLQSHRWVAETRSANPATGGVSLNLKKGTSKPTSVNCHVKFDANNVQIMTKIANHAL

SEQ ID NO: 742650 - protein, 88 aa, Homo sapiens
FLIPVELNLTAFPSCKYFSCFPSLPVPDIPLLSCRMAVEVAETPPTSFWGGRGNLVAAPQLVGRELVHVLGESVEQQERFDIHTDIGN

SEQ ID NO: 742651 - protein, 106 aa, Homo sapiens
GCGPTSVVRELHGPAQAYRKQQGQLHLPATLPASSCTPGRQMQPLPPSLTHQERGLRLPRSRATFETLVPGTWEPWACARSQGATGGGDRPWPESPPPQTPHGSVL

SEQ ID NO: 742652 - protein, 132 aa, Homo sapiens
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMTLTFGDVVAVRHYEKA

SEQ ID NO: 742653 - protein, 132 aa, Homo sapiens; identical to SEQ ID NO: 742652

SEQ ID NO: 742654 - protein, 132 aa, Homo sapiens; identical to SEQ ID NO: 742652

SEQ ID NO: 742655 - protein, 166 aa, Homo sapiens
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMVSNDNSPFFLVFFSSPHTSHLLPSSSLLLPFFLLPSFFNNTSLARFFNYM

SEQ ID NO: 742656 - protein, 81 aa, Homo sapiens
GTIIWLPVHETKVQKQFFLTWDLPKNTPICAPVGMLADFIPTVNLEAVLKPSSSPKTYLQSLSTKVWEQSCPPRNLEGEMP

SEQ ID NO: 742657 - protein, 97 aa, Homo sapiens
MVGCVYRLPLSSHAHDRRVWMYFTGSFSEAKWFYFVLTSALWCLIHANVVPFQLVITGCCYKDMAKTLFNLLKKKKKMTKKKTKKKKLPALFFFLFF

SEQ ID NO: 742658 - protein, 803 aa, Homo sapiens
MIPVTEFRQFSEQQPAFRVLKPWWDVFTDYLSVAMLMIGVFGCTLQVMQDKIICLPKRVQPAQNHSSLSNVSQAVASTTPLPPPKPSPANPITVEMKGLKTDLDLQQYSFINQMCYERALHWYAKYFPYLVLIHTLVFMLCSNFWFKFPGSSSKIEHFISILGKCFDSPWTTRALSEVSGEDSEEKDNRKNNMNRSNTIQSGPEGSLVNSQSLKSIPEKFVVDKSTAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWLFYRSLREYSFEYVRQETGIDDIPDVKNDFAFMLHMIDQYDPLYSKRFAVFLSEVSENKLKQLNLNNEWTPDKLRQKLQTNAHNRLELPLIMLSGLPDTVFEITELQSLKLEIIKNVMIPATIAQLDNLQELSLHQCSVKIHSAALSFLKENLKVLSVKFDDMRELPPWMYGLRNLEELYLVGSLSHDISRNVTLESLRDLKSLKILSIKSNVSKIPQAVVDVSSHLQKMCIHNDGTKLVMLNNLKKMTNLTELELVHCDLERIPHAVFSLLSLQELDLKENNLKSIEEIVSFQHLRKLTVLKLWHNSITYIPEHIKKLTSLERLSFSHNKIEVLPSHLFLCNKIRYLDLSYNDIRFIPPEIGVLQSLQYFSITCNKVESLPDELYFCKKLKTLKIGKNSLSVLSPKIGNLLFLSYLDVKGNHFEILPPELGDCRALKRAGLVVEDALFETLPSDVREQMKTE

SEQ ID NO: 742659 - protein, 141 aa, Homo sapiens
PLWARTNGLSLGGAAVGRPGPIRGAGGQSVGGAARARARNCPGAVAYGKTGEELRLCPVGAGGAAGRRLQLQLRREGSLAGPSSPTPGALRQGRAVQRASVLSVGLEPITESNPRAEESEDSQLAAAPSSACAPPIEGVLI

SEQ ID NO: 742660 - protein, 142 aa, Homo sapiens
PLWARTNGLSLGGAAVGRPGPIRGAGGQSVGGAARARARNCPGAVAYGKTGEELRLCPVGAGGAAGRRLQLQLRREGSLAGPSSPTPGALRQGRAVQRASVLSVGSQASITIQELQACSVYQHGITNHIASGQESHFIAKEP

SEQ ID NO: 742661 - protein, 141 aa, Homo sapiens; identical to SEQ ID NO: 742659

SEQ ID NO: 742662 - protein, 77 aa, Homo sapiens
AVSTRVRVCMRNVGCEHACLSLRADVGCEHACPSLRADVGCDVYCCTPGGGTTVSRGDCVLNVGGTASLFSVAAVAT

SEQ ID NO: 742663 - protein, 379 aa, Homo sapiens
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 742664 - protein, 379 aa, Homo sapiens; identical to SEQ ID NO: 742663

SEQ ID NO: 742665 - protein, 379 aa, Homo sapiens; identical to SEQ ID NO: 742663

SEQ ID NO: 742666 - protein, 379 aa, Homo sapiens; identical to SEQ ID NO: 742663

SEQ ID NO: 742667 - protein, 81 aa, Homo sapiens
EGGKTINQANAHNPVEMEVNALVKANVSVPKVTRETSVQSLSASLAVVHMEPAMNPTNANVKKVGMEDTAIKGTKPASYMP

SEQ ID NO: 742668 - protein, 131 aa, Homo sapiens
SERGVNCDKANCSTTCFNGGTCFYPGKCICPPGLEGEQCEISKCPQPCRNGGKCIGKSKSVCEPGCGAHGTCHEPNKCQCQEGWHGRHCNKRYEASLIHALRPAGAQLRQHTPSLKKAEERRDPPESNYIW

SEQ ID NO: 742669 - protein, 317 aa, Homo sapiens
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKLFGAWVGEPA

SEQ ID NO: 742670 - protein, 107 aa, Homo sapiens
MSRQLSLVRASRLLHPLCPITDPVADINSQAHVLVSFPPPARHQCLVWPNASAAPRQNHFCQPAQLQFGFWSSPIYGQRRGVDSFSQHKFVSSFHPFPRGKISKPKG

SEQ ID NO: 742671 - protein, 347 aa, Homo sapiens
MALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 742672 - protein, 347 aa, Homo sapiens; identical to SEQ ID NO: 742671

SEQ ID NO: 742673 - protein, 351 aa, Homo sapiens
SCHGSEASPAMWNSICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 742674 - protein, 71 aa, Homo sapiens
RQLGCGRAVLTQKRCNKHAYGRKPIWLSQMSCSGREATLQDCPSGPWGKNTCNHDEDTWVECEGNACASKD

SEQ ID NO: 742675 - protein, 94 aa, Homo sapiens
LRTVGACGVGGRERSGFGGGGGEERVLRVGGRSGGVEPGRACRVQTRDGRSWEVALWAELRGAGSYGAGLVGLFQTEARGSTRSVLDQPLKLQL

SEQ ID NO: 742676 - protein, 470 aa, Homo sapiens
GKRSEGVPVSGPMLIEKAKDFYEQMQLTEPCVFSGGWLWRFKARHGIKKLDASSEKQSADHQAAEQFCAFFRSLAAEHGLSAEQVYNADETGLFWRCLPNPTPEGGAVPGPKQGKDRLTVLMCANATGSHRLKPLAIGKCSGPRAFKGIQHLPVAYKAQGNAWVDKEIFSDWFHHIFVPSVREHFRTIGLPEDSKAVLLLDSSRAHPQEAELVSSNVFTIFLPASVASLVQPMEQGIRRDFMRNFINPPVPLQGPHARYNMNDAIFSVACAWNAVPSHVFRRAWRKLWPSVAFAEGSSSEEELEAECFPVKPHNKSFAHILELVKEGSSCPGQLRQRQAASWGVAGREAEGGRPPAATSPAEVVWSSEKTPKADQDGGGDPGEGEEVAWEQAAVAFDAVLRFAERQPCFSAQEVGQLRALRAVFRSQQQVRRRRGALGAVVKVEALQEGPGGCGATAQSPLPCSSTAGDN

SEQ ID NO: 742677 - protein, 458 aa, Homo sapiens
GKRSEGVPVSGPMLIEKAKDFYEQMQLTEPCVFSGGWLWRFKARHGIKKLDASSEKQSADHQAAEQFCAFFRSLAAEHGLSAEQVYNADETGLFWRCLPNPTPEGGAVPGPKQGKDRLTVLMCANATGSHRLKPLAIGKCSGPRAFKGIQHLPVAYKAQGNAWVDKEIFSDWFHHIFVPSVREHFRTIGLPEDSKAVLLLDSSRAHPQEAELVSSNVFTIFLPASVASLVQPMEQGIRRDFMRNFINPPVPLQGPHARYNMNDAIFSVACAWNAVPSHVFRRAWRKLWPSVAFAEGSSSEEELEAECFPVKPHNKSFAHILELVKEGSSCPGQLRQRQAASWGVAGREAEGGRPPAATSPAEVVWSSEKTPKADQDGGGDPGEGEEVAWEQAAVAFDAVLRFAERQPCFSAQEVGQLRALRAVFRSQQQETVGLEDVVVTSPEELAIPKCCLEASTET

SEQ ID NO: 742678 - protein, 1205 aa, Homo sapiens
MHVVCIPASAVDSTETSVLMKEEDLARCGFSYFHISVDTGAKVIADRALSMSWKCVFLALNACVKIIKAKEFLKISVLNDSPSSHLCPIVFVVSPALFASLSGELLHIMYFVPFLGSRVTPNESLLTKTAGLQLLEATQEVRTCPEGSETVGHPGWVELGRAWAGQLAELLAGSPESSGHGLSLSDCSSSGPELFPFLTCSCADCAGLMGRRLSPVSGCVLRVPLFQTNCSKAWSLTLGAALVAGIPCATQGTRALLLLQPLLTWARCWSEVFREPRAYSSLSCWAQLPGAYLLPRSCPPERFMETAVPPSTLFSLPDPSQKLKWLNVLASESFSPSLSGGAPLYQTPQHSSVRLCLFTLFLGLLRPLGSPGACQSRARKSLVLFKCLRVLSVSTRLEPLPVFSQCPCKLQPQFSSGSWGEQVLRHMVWDLCGCFQPANRTSFHHCLHLWGGTPECSGLRALLCPHSGQAASTLGAPIPRDAQERPYFQGGMVNSGVRMGRWSFSPFYVGVGLQNTCPACASLAFCEHPRHAVLEVVCLLHRRVRADLALGLSVRDFHMLHSCSAMAEHAMESTWTAPDVAGHCSYPVGQVIDVLVVGLIGRKEVAAPAHGFPSSLGLEDCHQLSPVKVHLEEVQGPQWLDVLVEGHGLRQGFAEGVDCIHSWEAVAQGSDNLGQIKTRPHCTSGTSPHAPHKCAYWGSGCGGFCLKSQYSGRPRQEDHFSSGVCNQPGQHRETPSLQKVKENEPGVVACACNPSYSGGRGGRIPKPRSLGCSELWPLHSSLGDRVRDQSLKTKNNKMCFGVRCGDQGRGGHEVGRGQDVDSHGLVGVAAVGVGGGLGGRAWAGLLHFCCLPSPLWVRGLSLTRAELSGTALDSAAYWEAGENGPVRPCLSSSLPSSCRPQAWLSAGPGAAAMAATSLPHEPQLPAPHAHSFAHVVSALASASTHGPSDLAHLLFPLQGSDDDMNEVGSLLFRDETGAQGGAGVKLLRAEGDPGLPAPNDQPHVLHCSLPAVHQLHDLEQLHSTVNRGENTPLPTVLGATLVGGLEPPFSSVVVLSLCIWVWPLLGPGLLGSTMASLLKALHPGADCGRPTGHGWALSQRACQHGHFHTQAGWEASYEVLKGPLCLQVAPSHTGEDRWASLVAKGTEVQSRECVAQCQHGLLWGQASCPGPKPPQAKACPWAHFLSRGLGFPISDVCERKACPLG

SEQ ID NO: 742679 - protein, 109 aa, Homo sapiens
MGRRLSPVSGCVLRVPLFQTNCSKAWSLTLGAALVAGIPCATQGTRALLLLQPLLTWARCWSEVFREPRAYSSLSCWAQLPGAYLLPRSCPPERFMETAVSSEHFVFTS

SEQ ID NO: 742680 - protein, 1205 aa, Homo sapiens; identical to SEQ ID NO: 742678

SEQ ID NO: 742681 - protein, 470 aa, Homo sapiens; identical to SEQ ID NO: 742676

SEQ ID NO: 742682 - protein, 470 aa, Homo sapiens; identical to SEQ ID NO: 742676

SEQ ID NO: 742683 - protein, 204 aa, Homo sapiens
MEAAGSPAATETGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 742684 - protein, 198 aa, Homo sapiens
MQALSNGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 742685 - protein, 198 aa, Homo sapiens; identical to SEQ ID NO: 742684

SEQ ID NO: 742686 - protein, 203 aa, Homo sapiens
MATPYVTDETGGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 742687 - protein, 195 aa, Homo sapiens
MKIGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 742688 - protein, 195 aa, Homo sapiens; identical to SEQ ID NO: 742687

SEQ ID NO: 742689 - protein, 204 aa, Homo sapiens; identical to SEQ ID NO: 742683

SEQ ID NO: 742690 - protein, 102 aa, Homo sapiens
MEAAGSPAATETASPLFLLLHLRPEMVHSPFKTKMVACYDRDSTSGGEGGGTPARSRRKWFAFSRWRLPMLLTRPAGWEPPNLSLLFDFTLGYHQGQRMEPR

SEQ ID NO: 742691 - protein, 198 aa, Homo sapiens
MLSAFQRLFRVLFVIETVSEYGVLIFIYGWPFLQTLAMLLIGTVSFHLWIRRNRERNSRSGKTRCRSKRSGAEHGHWERVLSARTVVDPASKLSLHQWLFPLGRGQEGTHLPACTHTFADLGGQTNLIRWSGSRYGQSCLVRPQPARPALCVVGRATSSRRRGGCDAFTRRPFAHGGFPEECVPPPGGVLYPGGKRGP

SEQ ID NO: 742692 - protein, 103 aa, Homo sapiens
RDRLTELSRAPWGTRHDPPPWSQRNLGPRNRKGPRRHFSTRCRMTPPEQMTAPKLLGLVFMMVYKLFINRQGLQTYFFLDTPTVRPRRPVVLVCWPRTRRPQK

SEQ ID NO: 742693 - protein, 197 aa, Homo sapiens
DAWVDPRRTHACGEAAAGKMADGKAGDEKPEKSQRAGAAGGPEEEAEKPVKTKTVSSSNGGESSSRSAEKRSAEEEAADLPTKPTKISKFGFAIGSQTTKKASAISIKLGSSKPKETVPTLAPKTLSVAAAFNEDEDSEPEEMPPEAKMRMKNIGRDTPTSAGPNSFNKGKHGFSDNQKLWERNIKSHLGNVHDQDN

SEQ ID NO: 742694 - protein, 71 aa, Homo sapiens
TSLAWLQGEAAAGKMADGKAGDEKPEKSQRAGAAGVMEGKVPVAALRSDQLKKKLPTSQQSLQRSPSLDLP

SEQ ID NO: 742695 - protein, 71 aa, Homo sapiens
VSSPPTPREAAAGKMADGKAGDEKPEKSQRAGAAGVMEGKVPVAALRSDQLKKKLPTSQQSLQRSPSLDLP

SEQ ID NO: 742696 - protein, 197 aa, Homo sapiens; identical to SEQ ID NO: 742693

SEQ ID NO: 742697 - protein, 81 aa, Homo sapiens
TRGSTHAGPTRAGRPRRGKWRTGRRETRSLKSRSELEPPEVYKLFINRQGLQTYFFLDTPTVRPRRPVVLVCWPRTRRPQK

SEQ ID NO: 742698 - protein, 69 aa, Homo sapiens
TRGSTHAGPTRAGRPRRGKWRTGRRETRSLKSRSELEPPELIHGSLFYCHTISVPAVYSNKQWKRLLGQ

SEQ ID NO: 742699 - protein, 158 aa, Homo sapiens
MLFEVAAPINLLSKNSSSCNGGESSSRSAEKRSAEEEAADLPTKPTKISKFGFAIGSQTTKKASAISIKLGSSKPKETVPTLAPKTLSVAAAFNEDEDSEPEEMPPEAKMRMKNIGRDTPTSAGPNSFNKGKHGFSDNQKLWERNIKSHLGNVHDQDN

SEQ ID NO: 742700 - protein, 132 aa, Homo sapiens
TAKARETHTRRPADLPTKPTKISKFGFAIGSQTTKKASAISIKLGSSKPKETVPTLAPKTLSVAAAFNEDEDSEPEEMPPEAKMRMKNIGRDTPTSAGPNSFNKGKHGFSDNQKLWERNIKSHLGNVHDQDN

SEQ ID NO: 742701 - protein, 197 aa, Homo sapiens; identical to SEQ ID NO: 742693

SEQ ID NO: 742702 - protein, 125 aa, Homo sapiens
TRGSTHAGPTRAGRPRRGKWRTGRRETRSLKSRSELEPPEKPKETVPTLAPKTLSVAAAFNEDEDSEPEEMPPEAKMRMKNIGRDTPTSAGPNSFNKGKHGFSDNQKLWERNIKSHLGNVHDQDN

SEQ ID NO: 742703 - protein, 197 aa, Homo sapiens; identical to SEQ ID NO: 742693

SEQ ID NO: 742704 - protein, 81 aa, Homo sapiens; identical to SEQ ID NO: 742697

SEQ ID NO: 742705 - protein, 149 aa, Homo sapiens
DAWVDPRRTHACGEAAAGKMADGKAGDEKPEKSQRAGAAGGPEEEAEKPVKTKTVSSSNGGESSSRSAEKRSAEEEAADLPTKPTKISKFGFAIGSQTTKKASAISIKLGSSKPKETVPTLAPKTLSVAAAFNEDEDGYTNISWTKLLQ

SEQ ID NO: 742706 - protein, 100 aa, Homo sapiens
TRGSTHAGPTRAGRPRRGKWRTGRRETRSLKSRSELEPPESEPEEMPPEAKMRMKNIGRDTPTSAGPNSFNKGKHGFSDNQKLWERNIKSHLGNVHDQDN

SEQ ID NO: 742707 - protein, 81 aa, Homo sapiens; identical to SEQ ID NO: 742697

SEQ ID NO: 742708 - protein, 124 aa, Homo sapiens
DAWVDPRRTHACGEAAAGKMADGKAGDEKPEKSQRAGAAGGPEEEAEKPVKTKTVSSSNGGESSSRSAEKRSAEEEAADLPTKPTKISKFGFAIGSQTTKKASAISIKLGSSGYTNISWTKLLQ

SEQ ID NO: 742709 - protein, 197 aa, Homo sapiens; identical to SEQ ID NO: 742693

SEQ ID NO: 742710 - protein, 81 aa, Homo sapiens; identical to SEQ ID NO: 742697

SEQ ID NO: 742711 - protein, 81 aa, Homo sapiens; identical to SEQ ID NO: 742697

SEQ ID NO: 742712 - protein, 629 aa, Homo sapiens
MLWTSGPFCRVPSEAGNLCSTLRLSREALGGDTELQTNIRARGCGTEERRRPLGTEVGPGLELSWRGWRWCRSHAVVGTELRAGGRGSAEGAGRERARGVGQRLAPTATDYSLRPPLFVAVTCFRQSTRSSLLGACLRVLRLSCFSLSILLCLSLPSLGAGASSGLRRMRPADLPPRPMEESPASSSAPTETEEPGSSAEVMEEVTTCSFNSPLFRQEDDRGITYRIPALLYIPPTHTFLAFAEKRSTRRDEDALHLVLRRGLRIGQLVQWGPLKPLMEATLPGHRTMNPCPVWEQKSGCVFLFFICVRGHVTERQQIVSGRNAARLCFIYSQDAGCSWSEVRDLTEEVIGSELKHWATFAVGPGHGIQLQSGRLVIPAYTYYIPSWFFCFQLPCKTRPHSLMIYSDDLGVTWHHGRLIRPMVTVECEVAEVTGRAGHPVLYCSARTPNRCRAEALSTDHGEGFQRLALSRQLCEPPHGCQGSVVSFRPLEIPHRCQDSSSKDAPTIQQSSPGSSLRLEEEAGTPSESWLLYSHPTSRKQRVDLGIYLNQTPLEAACWSRPWILHCGPCGYSDLAALEEEGLFGCLFECGTKQECEQIAFRLFTHREILSHLQGDCTSPGRNPSQFKSN

SEQ ID NO: 742713 - protein, 338 aa, Homo sapiens
MLWTSGPFCRVPSEAGNLCSTLRLSREALGGDTELQTNIRARGCGTEERRRPLGTEVGPGLELSWRGWRWCRSHAVVGTELRAGGRGSAEGAGRERARGVGQRLAPTATDYSLRPPLFVAVTCFRQSTRSSLLGACLRVLRLSCFSLSILLCLSLPSLGAGASSGLRRMRPADLPPRPMEESPASSSAPTETEEPGSSAEVMEEVTTCSFNSPLFRQEDDRGITYRIPALLYIPPTHTFLAFAEKRSTRRDEDALHLVLRRGLRIGQLVQVTLHPRSESGPQFLFTKLRALQDLCLFSSVQESPVWGAEAEKTAKTMALTECLLCARGTLGPHSHSVS

SEQ ID NO: 742714 - protein, 461 aa, Homo sapiens
MRPADLPPRPMEESPASSSAPTETEEPGSSAEVMEEVTTCSFNSPLFRQEDDRGITYRIPALLYIPPTHTFLAFAEKRSTRRDEDALHLVLRRGLRIGQLVQWGPLKPLMEATLPGHRTMNPCPVWEQKSGCVFLFFICVRGHVTERQQIVSGRNAARLCFIYSQDAGCSWSEVRDLTEEVIGSELKHWATFAVGPGHGIQLQSGRLVIPAYTYYIPSWFFCFQLPCKTRPHSLMIYSDDLGVTWHHGRLIRPMVTVECEVAEVTGRAGHPVLYCSARTPNRCRAEALSTDHGEGFQRLALSRQLCEPPHGCQGSVVSFRPLEIPHRCQDSSSKDAPTIQQSSPGSSLRLEEEAGTPSESWLLYSHPTSRKQRVDLGIYLNQTPLEAACWSRPWILHCGPCGYSDLAALEEEGLFGCLFECGTKQECEQIAFRLFTHREILSHLQGDCTSPGRNPSQFKSN

SEQ ID NO: 742715 - protein, 226 aa, Homo sapiens
MLWTSGPFCRVPSEAGNLCSTLRLSREALGGDTELQTNIRARGCGTEERRRPLGTEVGPGLELSWRGWRWCRSHAVVGTELRAGGRGSAEGAGRERARGVGQRLAPTATDYSLRPPLFVAVTCFRQSTRSSLLGACLRVLRLSCFSLSILLCLSLPSLGAGASSGLRRMRPADLPPRPMEESPASSSAPTETEEPGSSAAPDLCETFWVAMPESPSILLLSSTRSA

SEQ ID NO: 742716 - protein, 309 aa, Homo sapiens
GRPGRRRARVDGVRLHDPTGAGGQQRGGGHRAVVVRVLAGRRAAAAAHVRVAAVGRQVGHRVAGQGHAVHVARQVAVHHAQAALQRQAVGRAREAAGRALEAVGVREVVEAEPVHHAVHGLERLAFPSEAARPPPKGALLEHELAGRVDGPVVALAGPPKALGELDEALVEREVVAHGVLPALVGAPEEGEAALQELVDLAQRQALGGGTLDGHDDERDVGIGRLLRAPDAGVGLLGLGRAGRRGVHGRAASPAAAAAAAVRWLLLLGRRRHRVAAAAAAAAAAALRRGPSCRIRHEVLPLFEYLSLST

SEQ ID NO: 742717 - protein, 109 aa, Homo sapiens
TAAEFAPPVGAAMPGAGSWSASQNRTKAKTKPSLRSRNRTDVAGESQIFPAVLVNTIEQGSEANIIRWLDSDTSRSSLGSKVLLSGFSPALPKMIDYAGPTGCPAIPNK

SEQ ID NO: 742718 - protein, 123 aa, Homo sapiens
PSAPVESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGEEGWELGNQWP

SEQ ID NO: 742719 - protein, 168 aa, Homo sapiens
KLTRQDQNPGQPHPALPCHWRSMATGAWVLAKLQTSLPTVSSFLFSQGSVSLSGNSEIFLVPPTPHSNPGRTLGLRQHHRAAAGGAWHSSLAENMKLLLWGLALVTPMWQPLFRLFNNLENAYNSAGSFISGFRNTMPWGLLPAKSEIPLVTVTEDVSLFLEGALVSG

SEQ ID NO: 742720 - protein, 146 aa, Homo sapiens
LILVPGFWFTGARGPSWLPGCQQGLGREIHRPRLISSLLRGLSSPDRPSCVQWLLEESVGTVAWRLVAGRLVPSDLVLAVGVAAPAAFPTRLGAEPVAKRPMPLGCLRVRALPLCPNGCSQMKETEGQGRCQVDQSFLRSAITMKW

SEQ ID NO: 742721 - protein, 133 aa, Homo sapiens
SEAGVGCCSLLRAQGSRGFSGAGWRPRQAAAMNFSEVFKLSSLLCKFSPDGKYLASCVQYRLVVRDVNTLQILQLYTCLDQIQHIEWSADSLFILCAMYKRGLVQVCAAVSLRIWTPSEGPWEGGVLFCAFLV

SEQ ID NO: 742722 - protein, 466 aa, Homo sapiens
SEAGVGCCSLLRAQGSRGFSGAGWRPRQAAAMNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNDNIPNAVWVWDIQKLRLFAVLEQLSPVRAFQWDPQQPRLAICTGGSRLYLWSPAGCMSVQVPGEGKHIPEATDVAALLCAVWHHTG

SEQ ID NO: 742723 - protein, 491 aa, Homo sapiens
SEAGVGCCSLLRAQGSRGFSGAGWRPRQAAAMNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNDNIPNAVWVWDIQKLRLFAVLEQLSPVRAFQWDPQQPRLAICTGGSRLYLWSPAGCMSVQVPGEGDFAVLSLCWHLSGDSMALLSKDHFCLCFLETEAVVGTACRQLGGHT

SEQ ID NO: 742724 - protein, 340 aa, Homo sapiens
SEAGVGCCSLLRAQGSRGFSGAGWRPRQAAAMNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKCK

SEQ ID NO: 742725 - protein, 340 aa, Homo sapiens
SEAGVGCCSLLRAQGSRGFSGAGWRPRQAAAMNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVSLEHVFLPEQAVGEGGGKLLLHFAFLIVVYYLTGHF

SEQ ID NO: 742726 - protein, 491 aa, Homo sapiens; identical to SEQ ID NO: 742723

SEQ ID NO: 742727 - protein, 161 aa, Homo sapiens
LSTSWQFQLFHGHADSPASFVLSAPMSLCSTRVCGVFLATGVYSLLTEMSHLQYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKCK

SEQ ID NO: 742728 - protein, 384 aa, Homo sapiens
SEAGVGCCSLLRAQGSRGFSGAGWRPRQAAAMNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNGQLC

SEQ ID NO: 742729 - protein, 446 aa, Homo sapiens
SEAGVGCCSLLRAQGSRGFSGAGWRPRQAAAMNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNDNIPNAVWVWDIQKLRLFAVLEQLSPVRAFQWDPQQPRLAICTGGSRLYLWSPAGCMSVQVPGEGDFAVLSLCWHLSGDSMALLSKDHFCLCFLETEAVVGTACRQLGGHT

SEQ ID NO: 742730 - protein, 194 aa, Homo sapiens
SEAGVGCCSLLRAQGSRGFSGAGWRPRQAAAMNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRHILNTTEFHLRITVWSS

SEQ ID NO: 742731 - protein, 313 aa, Homo sapiens
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGNKADYPEGDGNWANYNTFGSAEAATSDDYKNPGYYDIQAKDLGIWHVPNKSPMQHWRNSALLRYRTNTGFLQRLGHNLFGIYQKYPVKYRSGKCWNDNGPAIPVVYDFGDAKKTASYYSPYGQREFVAGFVQFRVFNNERAANALCAGIKVTGCNTEHHCIGGGGFFPQGKPRQCGDFSAFDWDGYGTHVKSSCSREITEAAVLLFYR

SEQ ID NO: 742732 - protein, 199 aa, Homo sapiens
MWTFCLLVPPGPAGSVSVAFQNPGYYDIQAKDLGIWHVPNKSPMQHWRNSALLRYRTNTGFLQRLGHNLFGIYQKYPVKYRSGKCWNDNGPAIPVVYDFGDAKKTASYYSPYGQREFVAGFVQFRVFNNERAANALCAGIKVTGCNTEHHCIGGGGFFPQGKPRQCGDFSAFDWDGYGTHVKSSCSREITEAAVLLFYR

SEQ ID NO: 742733 - protein, 242 aa, Homo sapiens
MTSGGGGWTLVASVHENDMRGKCTVGDRWSSQQGNKADYPEGDGNWANYNTFGSAEAATSDDYKNPGYYDIQAKDLGIWHVPNKSPMQHWRNSALLRYRTNTGFLQRLGHNLFGIYQKYPVKYRSGKCWNDNGPAIPVVYDFGDAKKTASYYSPYGQREFVAGFVQFRVFNNERAANALCAGIKVTGCNTEHHCIGGGGFFPQGKPRQCGDFSAFDWDGYGTHVKSSCSREITEAAVLLFYR

SEQ ID NO: 742734 - protein, 130 aa, Homo sapiens; identical to SEQ ID NO: 742470

SEQ ID NO: 742735 - protein, 691 aa, Homo sapiens
MDQNQHLNKTAEAQPSENKKTRYCNGLKMFLAALSLSFIAKTLGAIIMKSSIIHIERRFEISSSLVGFIDGSFEIGNLLVIVFVSYFGSKLHRPKLIGIGCFIMGIGGVLTALPHFFMGYYRYSKETNINSSENSTSTLSTCLINQILSLNRASPEIVGKGCLKESGSYMWIYVFMGNMLRGIGETPIVPLGLSYIDDFAKEGHSSLYLGILNAIAMIGPIIGFTLGSLFSKMYVDIGYVDLSTIRITPTDSRWVGAWWLNFLVSGLFSIISSIPFFFLPQTPNKPQKERKASLSLHVLETNDEKDQTANLTNQGKNITKNVTGFFQSFKSILTNPLYVMFVLLTLLQVSSYIGAFTYVFKYVEQQYGQPSSKANILLGVITIPIFASGMFLGGYIIKKFKLNTVGIAKFSCFTAVMSLSFYLLYFFILCENKSVAGLTMTYDGNNPVTSHRDVPLSYCNSDCNCDESQWEPVCGNNGITYISPCLAGCKSSSGNKKPIVFYNCSCLEVTGLQNRNYSAHLGECPRDDACTRKFYFFVAIQVLNLFFSALGGTSHVMLIVKIVQPELKSLALGFHSMVIRALGGILAPIYFGALIDTTCIKWSTNNCGTRGSCRTYNSTSFSRVYLGLSSMLRVSSLVLYIILIYAMKKKYQEKDINASENGSVMDEANLESLNKNKHFVPSAGADSETHC

SEQ ID NO: 742736 - protein, 691 aa, Homo sapiens; identical to SEQ ID NO: 742735

SEQ ID NO: 742737 - protein, 83 aa, Homo sapiens
LRAVGAQGWVLGWKDVSERGCSHRVDRRSRKQEGCVWSGGAWNAALWFPWGGVGGSGLEQADTALWTLRPLNWDRSAPWWGGA

SEQ ID NO: 742738 - protein, 98 aa, Homo sapiens
VLAPLTAAGSLTCELQVCSRWSLDARNGARTLDVERGGGGTRSGDLHLGWSALRMPSKVTAWSTSRRGLCASVGIAADGETFGVAEECPQTSEVAREN

SEQ ID NO: 742739 - protein, 113 aa, Homo sapiens
VLAPLTAAGSLTCELQVCSRWSLDARNGARTLDVERGGGGTRSGDLHLGWSALRMPSKVTAWSTSRRGLCASVGIAADGETFGVAEECPQTSEGPRRQGPCSHGVTPGCRSLG

SEQ ID NO: 742740 - protein, 106 aa, Homo sapiens
CASVGIAADGETFGVAEECPQTSEGIRYILHSRVSLPRAIFWGSGKSCSRARAGWLEPLVRRTLAEVQAAPVSQAAVSDASLGPEWSQEGCRPGLTSGQHGGRDGR

SEQ ID NO: 742741 - protein, 102 aa, Homo sapiens
PARDTCIKPHFPQQQSLVPVCPLADSSPDQPVLSPPARTHSKDRGRLSSASLLPRARLQPFEALSIDYGDAPSHCPSPSLFNSQQNSILQNDTKLILILEFK

SEQ ID NO: 742742 - protein, 174 aa, Homo sapiens
MEIAPQEAPPVPGADGDIEEAPAEAGSPSPASPPADGRLKAAAKRVTFPSDEDIVSGAVEPKDPWRHAQNVTVDEVIGAYKQACQKLNCRQIPKLLRQLQEFTDLGHRLDCLDLKGEKLDYKTCEALEEVFKRLQFKVVDLEQTNLDEDGASALFDMIEYYESATHLNISFNKH

SEQ ID NO: 742743 - protein, 179 aa, Homo sapiens
MPCVGRTAAGAVTEHGGQKPVFTKAPQVVLTTSLGCLCALLRHPSLSPKPAFRPQFRGGWHGPQSLFWSKLTAQNVTVDEVIGAYKQACQKLNCRQIPKLLRQLQEFTDLGHRLDCLDLKGEKLDYKTCEALEEVFKRLQFKVVDLEQTNLDEDGASALFDMIEYYESATHLNISFNKH

SEQ ID NO: 742744 - protein, 126 aa, Homo sapiens
MEIAPQEAPPVPGADGDIEEAPAEAGSPSPASPPADGRLKAAAKRVTFPSDEDIVSGAVEPKDPWRHGEKLDYKTCEALEEVFKRLQFKVVDLEQTNLDEDGASALFDMIEYYESATHLNISFNKH

SEQ ID NO: 742745 - protein, 153 aa, Homo sapiens
AEARLGSRRRRLRPLGERTEAAPEAAAEPMPRDGGRTRRDKSGARGMSPGPREEAAAAMEIAPQEAPPVPGADGDIEEAPAEAGSPSPASPPADGRLKAAAKRVTFPSDEDIVSGAVEPKDPWRHGWSAMARSQVITTSASQVQAILLPQPPE

SEQ ID NO: 742746 - protein, 160 aa, Homo sapiens
MEIAPQEAPPVPGADGDIEEAPAEAGSPSPASPPADGRLKAAAKRVTFPSDEDIVSGAVEPKDPWRHAQNVTVDEVIGAYKQACQKLNCRQIPKLLRQLQEFTDLGHRLDCLDLKGEKLDYKTCEALEEVFKRLQFKVVDLEQTNLDEDVSGPATAHLAP

SEQ ID NO: 742747 - protein, 505 aa, Homo sapiens
NSGFVHPLWNRSCVACRNDIALISLRTRFRRWQRWPSPELPAMAGAPGPLRLALLLLGMVGRAGPRPQGATVSLWETVQKWREYRRQCQRSLTEDPPPATDLFCNRTFDEYACWPDGEPGSFVNVSCPWYLPWASSVPQGHVYRFCTAEGLWLQKDNSSLPWRDLSECEESKRGERSSPEEQLLFLYIIYTVGYALSFSALVIASAILLGFRHLHCTRNYIHLNLFASFILRALSVFIKDAALKWMYSTAAQQHQWDGLLSYQDSLSCRLVFLLMQYCVAANYYWLLVEGVYLYTLLAFSVLSEQWIFRLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 742748 - protein, 505 aa, Homo sapiens; identical to SEQ ID NO: 742747

SEQ ID NO: 742749 - protein, 505 aa, Homo sapiens; identical to SEQ ID NO: 742747

SEQ ID NO: 742750 - protein, 206 aa, Homo sapiens
ELNVQKPSERLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 742751 - protein, 120 aa, Homo sapiens
MAGAPGPLRLALLLLGMVGRAGPRPQVRSRDPDDTGGGGWLCGLQAQCPGGGPRDLNETPRPLAGASESLGGSRDWRLGAPGLEGPGEGLDYRGFPPTPARRPLPRHPGPSARAPAAPRP

SEQ ID NO: 742752 - protein, 651 aa, Homo sapiens
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 742753 - protein, 170 aa, Homo sapiens
MAAPLLHTRLPGDAAASSSAVKKLGASRTGISNMRALENDFFNSPPRKTVRFGGTVTEVLLKYKKLHPHADDNSQDTCRASAGGRNSTRQRMIRLKTHFRAISSHPHSTHQTPPLTQHDKYQEHLARDDLREGRIPPVRRDEYSYKTPFRGVSIDSPACAHISIHTIRKN

SEQ ID NO: 742754 - protein, 89 aa, Homo sapiens
ISSVPDLDSEDDVNASRQGIEDAEETATQTCGGTDSTEGLFNMDEDEETEHETKAGPERLDQMVHPVAEPFRTSLCVMFSLHLHLQNPN

SEQ ID NO: 742755 - protein, 651 aa, Homo sapiens; identical to SEQ ID NO: 742752

SEQ ID NO: 742756 - protein, 454 aa, Homo sapiens
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLMIREQRHSAMLLSMDHFTQPAKLCSTPLFLDTSSF

SEQ ID NO: 742757 - protein, 634 aa, Homo sapiens
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKNDTVIGITPSSFDTHFRSPSSSVGSPPVLYMQPSPL

SEQ ID NO: 742758 - protein, 621 aa, Homo sapiens
MAAPLLHTRLPGDAAASSSAVKKLGASRTGISNMRALENDFFNSPPRKTVRFGGTVTEVLLKYKKGETNDFELLKNQLLDPDIKRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 742759 - protein, 339 aa, Homo sapiens
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGVGRHEC

SEQ ID NO: 742760 - protein, 241 aa, Homo sapiens
KVDLNFSFLSTVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 742761 - protein, 119 aa, Homo sapiens
VVNRWGLHCQLGALSTGQSSWCLHGQKEVVKVANSPGEREFCSRTGCKSTITNLLVGEKFKKPMKKDIVEDEDDDFLKGEVPQNDTVIGITPSSFDTHFRSPSSSVGSPPVLYMQPSPL

SEQ ID NO: 742762 - protein, 412 aa, Homo sapiens
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLVSKNVINIILAYFVFAQKFSLKTGVDGDHEVNNSFL

SEQ ID NO: 742763 - protein, 454 aa, Homo sapiens; identical to SEQ ID NO: 742756

SEQ ID NO: 742764 - protein, 328 aa, Homo sapiens
HEGGKGDGMEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 742765 - protein, 95 aa, Homo sapiens
AGCIAQPCRIDTKMESKEISGTREVFENHPFRFKRREPHQFLKRENVQDQAVTERGTHWAAHPARPDQLRDGVGHSKRTRCWCGPKPLSQRHFNH

SEQ ID NO: 742766 - protein, 328 aa, Homo sapiens; identical to SEQ ID NO: 742764

SEQ ID NO: 742767 - protein, 328 aa, Homo sapiens; identical to SEQ ID NO: 742764

SEQ ID NO: 742768 - protein, 328 aa, Homo sapiens; identical to SEQ ID NO: 742764

SEQ ID NO: 742769 - protein, 328 aa, Homo sapiens; identical to SEQ ID NO: 742764

SEQ ID NO: 742770 - protein, 310 aa, Homo sapiens
PRRRQRRRNGGGASRLSRGRQRPGGQRGFMSGMPQPAAVRFWSGGHSGHGSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 742771 - protein, 305 aa, Homo sapiens
HEGGKGDGMEEVPHDCPGADSAQAGRGASCQGCPNQRLCASGAGATPDTAIEEIKEKMKTVKHKILVLSGKGGVGKSTFSAHLAHGLAEDENTQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 742772 - protein, 328 aa, Homo sapiens
VQTFGVCAWLRSQWGKGDGMEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 742773 - protein, 316 aa, Homo sapiens
HEGGKGDGMEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQSKYFHEY

SEQ ID NO: 742774 - protein, 300 aa, Homo sapiens
HEGGKGDGMEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGIQEFCNLHQSKEENLISS

SEQ ID NO: 742775 - protein, 300 aa, Homo sapiens; identical to SEQ ID NO: 742774

SEQ ID NO: 742776 - protein, 92 aa, Homo sapiens
HEGGKGDGMEEVPHDCPGADSAQAGRGASCQGCPNQRLCASGAGATPDTAIEEIKEKMKTVKHKILVLSGKGGVGKTAHHRGGGEHEWLHLS

SEQ ID NO: 742777 - protein, 283 aa, Homo sapiens
HEGGKGDGMEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKIDAPDSPATLAYRSIIQRIQEFCNLHQSKEENLISS

SEQ ID NO: 742778 - protein, 249 aa, Homo sapiens
HEGGKGDGMEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRADKPILKAGRAYHKYKAKRNCWPRVRGVAMNPVEHPFGGGNHQHIGKPSTIRRDAPAGRKVGLIAARRTGRLRGTKTVQEKEN

SEQ ID NO: 742779 - protein, 134 aa, Homo sapiens
HEGGKGDGMEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVIAGYRTQEIILLRQTL

SEQ ID NO: 742780 - protein, 126 aa, Homo sapiens
VFFCRDEGFAMLSRLVSNSWAQAVLHLGPPECWDYRCEPPYPAYLKPFSLFSKLQKREDSEKLKSVGAVEGSRIDVVFDICIEKIANFFFFLMVILDTSLIILEIFKTVNMRNNSYMCTFFLQMSN

SEQ ID NO: 742781 - protein, 115 aa, Homo sapiens
ARFLLFIIIVCFEMQSCSVTQGVHWATRARLYLNTTTRLLITEEKLGAEGTVGREGRREPRLQNESEWAEGHLRPQGQGTHNGSHTVSAVLLGEPVCSQRSIQTHYQSGFFSGTP

SEQ ID NO: 742782 - protein, 82 aa, Homo sapiens
MDHSHPAEQVSNLGVNLDTFLLIPMFLVSQSSPLIPKNLECLPGTSMSLAGHLGLSTHHLFPASVQCPTDRSFPRTLAFSNS

SEQ ID NO: 742783 - protein, 229 aa, Homo sapiens
SLPGGSILTTAVSVPRSPAVQCEGALGPEPLLPHYPDAQPRRHTGLPSPVLTAEEISQTQALGAGQLAAGTCEIVTLDRDSSQPRRTIARQTARCACRKGQIAGTTRARPACVDARIIKTKQWCDMLPCLEGEGCDLLINRSGWTCTQPGGAERAAVVEASTPGAPRAPSEDGLRLRGGRGTPAGGSDGPHADAGNAGRFIPLYLDQLDRTKIPFCFNQLNMPLLQLHF

SEQ ID NO: 742784 - protein, 125 aa, Homo sapiens
MQLLKALWALAGAALCCFLVLVIHAQFLKEGQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 742785 - protein, 125 aa, Homo sapiens; identical to SEQ ID NO: 742784

SEQ ID NO: 742786 - protein, 195 aa, Homo sapiens
MQLLKALWALAGAALCCFLVLVIHAQFLKEGQLAAGTCEIVTLDRDSSQPRRTIARQTARCACRKGQIAGTTRARPACVDARIIKTKQWCDMLPCLEGEGCDLLINRSGWTCTQPGGAERAAVVEASTPGAPRAPSEDGLRLRGGRGTPAGGSDGPHADAGNAGRFIPLYLDQLDRTKIPFCFNQLNMPLLQLHF

SEQ ID NO: 742787 - protein, 171 aa, Homo sapiens
AAAAEDGARGARTWRPARGRGQGRLLRRAAAPRAGAAASMAPSPRTGSRQDATALPSMSSTFWAFMILASLLIAYCSQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 742788 - protein, 159 aa, Homo sapiens
SLPGGSILTTAVSVPRSPAVQCEGALGPEPLLPHYPDAQPRRHTGLPSPVLTAEEISQTQALGAGQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 742789 - protein, 138 aa, Homo sapiens
NDSRGVGPKEDYKMHFLNALWALGGALLCCLLTLTIHAQNIKQRQLGTSRWEMATSDTHSLQTVTTIASQPSDVRVEMSGSGWTMTAWSSCVDSRIIKTKQWCDMLPCLEGEGCDLLINRSGWTCTQPGGRIKTTTVS

SEQ ID NO: 742790 - protein, 111 aa, Homo sapiens
MQQHLFPLGNTPESVNPLFACWFSAQKGPKQQVSLNVQFSELLSCVPRKHSSCKNQALQTSRTPVEGTGERNHSYFYPLIPGPVNPGYRRDNTCKAEPWGQHPKVVSQVVL

SEQ ID NO: 742791 - protein, 421 aa, Homo sapiens
MAESWLRLSGAGPAEEAGPEGGLEEPDALDDSLTSLQWLQEFSILNAKAPALPPGGTDPHGYHQVPGSAAPGSPLAADPACLGQPHTPGKPTSSCTSRSAPPGLQAPPPDDVDYATNPHVKPPYSYATLICMAMQASKATKITLSAIYKWITDNFCYFRHADPTWQNSIRHNLSLNKCFIKVPREKDEPGKGGFWRIDPQYAERLLSGAFKKRRLPPVHIHPAFARQAAQEPSAVPRAGPLTVNTEAQQLLREFEEATGEAGWGAGEGRLGHKRKQPLPKRVAKVPRPPSTLLPTPEEQGELEPLKGNFDWEAIFDAGTLGGELGALEALELSPPLSPASHVDVDLTIHGRHIDCPATWGPSVEQAADSLDFDETFLATSFLQHPWDESGSGCLPPEPLFEAGDATLASDLQDWASVGAFL

SEQ ID NO: 742792 - protein, 421 aa, Homo sapiens; identical to SEQ ID NO: 742791

SEQ ID NO: 742793 - protein, 421 aa, Homo sapiens; identical to SEQ ID NO: 742791

SEQ ID NO: 742794 - protein, 240 aa, Homo sapiens [sequence omitted]

SEQ ID NO: 742795 - protein, 132 aa, Homo sapiens
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGMNV

SEQ ID NO: 742796 - protein, 167 aa, Homo sapiens
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKAAMASIYWTFFPRKSEIVSSHAPHSQVTFCRNMANKLRLLEYRTNPFGYKDRYQLMQDRGK

SEQ ID NO: 742797 - protein, 311 aa, Homo sapiens
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHEVVRTRLREEGTKYRSFFQTLSLLVQEEGYGSLYRGLTTHLVRQIPNTAIMMATYELVVYLLNG

SEQ ID NO: 742798 - protein, 261 aa, Homo sapiens [sequence omitted]

SEQ ID NO: 742799 - protein, 340 aa, Homo sapiens
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAEHKKLNTKECKIFHKYGCAILLAIVQKVKGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHEVVRTRLREEGTKYRSFFQTLSLLVQEEGYGSLYRGLTTHLVRQIPNTAIMMATYELVVYLLNG

SEQ ID NO: 742800 - protein, 311 aa, Homo sapiens; identical to SEQ ID NO: 742797

SEQ ID NO: 742801 - protein, 311 aa, Homo sapiens; identical to SEQ ID NO: 742797

SEQ ID NO: 742802 - protein, 311 aa, Homo sapiens; identical to SEQ ID NO: 742797

SEQ ID NO: 742803 - protein, 311 aa, Homo sapiens; identical to SEQ ID NO: 742797

SEQ ID NO: 742804 - protein, 311 aa, Homo sapiens; identical to SEQ ID NO: 742797

SEQ ID NO: 742805 - protein, 311 aa, Homo sapiens; identical to SEQ ID NO: 742797

SEQ ID NO: 742806 - protein, 268 aa, Homo sapiens
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHEVVRTRTTCQPLTGPLRSHQV

SEQ ID NO: 742807 - protein, 106 aa, Homo sapiens
MSQRDTLVHLFAGGCGGTVGAILTCPLEVVKTRLQSSSVTLYISEVQLNTMAGASVNRVVSPGPLHCLKAIYFAAYSNCKEKLNDVFDPDSTQVHMISAAMAGMNV

SEQ ID NO: 742808 - protein, 297 aa, Homo sapiens
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAEHKKLNTKECKIFHKYGCAILLAIVQKVKGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHEVVRTRTTCQPLTGPLRSHQV

SEQ ID NO: 742809 - protein, 140 aa, Homo sapiens
MAGASVNRVVSPGPLHCLKVILEKEGPRSLFRGLGPNLVGVAPSRAIYTMYRLCESVRSAGSVLARSRRLGRGGGGTSREGRAGPTPSWHSRRAGEEVPMAPPDTKHGENSLNNGTKLRLSPEEPPWASGWGRTAVQSLQ

SEQ ID NO: 742810 - protein, 112 aa, Homo sapiens
MDGEEKTYGGCEGPDAMYVKLISSDGHEFIVKREHALTSGTIKAMLSGPGQFAENETNEVNFREIPSHVLSKVCMYFTYKVRYTNSSTEIPEFPIAPEIALELLMAANFLDC

SEQ ID NO: 742811 - protein, 112 aa, Homo sapiens; identical to SEQ ID NO: 742810

SEQ ID NO: 742812 - protein, 73 aa, Homo sapiens
NPKARYEAWVLAATGTDLPRVAESGSDPAEVILSTAPEPTGAGSWGWGGGPGIGAVAVRGDPAAVAAGLTRNY

SEQ ID NO: 742813 - protein, 107 aa, Homo sapiens
TTTKFAAASDAMYVKLISSDGHEFIVKREHALTSGTIKAMLSGPGQFAENETNEVNFREIPSHVLSKVCMYFTYKVRYTNSSTEIPEFPIAPEIALELLMAANFLDC

SEQ ID NO: 742814 - protein, 79 aa, Homo sapiens
INRIHTCVYLYYLFKPGQFAENETNEVNFREIPSHVLSKVCMYFTYKVRYTNSSTEIPEFPIAPEIALELLMAANFLDC

SEQ ID NO: 742815 - protein, 112 aa, Homo sapiens; identical to SEQ ID NO: 742810

SEQ ID NO: 742816 - protein, 112 aa, Homo sapiens; identical to SEQ ID NO: 742810

SEQ ID NO: 742817 - protein, 112 aa, Homo sapiens; identical to SEQ ID NO: 742810

SEQ ID NO: 742818 - protein, 112 aa, Homo sapiens; identical to SEQ ID NO: 742810

SEQ ID NO: 742819 - protein, 112 aa, Homo sapiens; identical to SEQ ID NO: 742810

SEQ ID NO: 742820 - protein, 181 aa, Homo sapiens
NPKARYEAWVLAATGTDLPRVAESGSDPAEVILSTAPEPTGAGSWGWGGGPGIGAVAVRGDPAAVAAGLTNGEEKTYGGCEGPDAMYVKLISSDGHEFIVKREHALTSGTIKAMLSGPGQFAENETNEVNFREIPSHVLSKVCMYFTYKVRYTNSSTEIPEFPIAPEIALELLMAANFLDC

SEQ ID NO: 742821 - protein, 112 aa, Homo sapiens; identical to SEQ ID NO: 742810

SEQ ID NO: 742822 - protein, 112 aa, Homo sapiens; identical to SEQ ID NO: 742810

SEQ ID NO: 742823 - protein, 90 aa, Homo sapiens
NPKARYEAWVLAATGTDLPRVAESGSDPAEVILSTAPEPTGAGSWGWGGGPGIGAVAVRGDPAAVAAGLTKSCCVAQAGVPGWSQIPDLK

SEQ ID NO: 742824 - protein, 181 aa, Homo sapiens; identical to SEQ ID NO: 742820

SEQ ID NO: 742825 - protein, 90 aa, Homo sapiens; identical to SEQ ID NO: 742823

SEQ ID NO: 742826 - protein, 88 aa, Homo sapiens
NPKARYEAWVLAATGTDLPRVAESGSDPAEVILSTAPEPTGAGSWGWGGGPGIGAVAVRGDPAAVAAGLTRSSGKEDLSEELMFYLET

SEQ ID NO: 742827 - protein, 104 aa, Homo sapiens
NPKARYEAWVLAATGTDLPRVAESGSDPAEVILSTAPEPTGAGSWGWGGGPGIGAVAVRGDPAAVAAGLTKIGSHCVVQAGLSLLGSGSTPASAIQSAGITGNY

SEQ ID NO: 742828 - protein, 112 aa, Homo sapiens; identical to SEQ ID NO: 742810

SEQ ID NO: 742829 - protein, 144 aa, Homo sapiens
MDGEEKTYGGCEGPDAMYVKLISSDGHEFIVKREHALTSGTIKAMLSGPGQFAENETNEVNFREIPSHVLSKVCMYFTYKVRYTNSSTEIPEFPIAPEIALELLMAVIPALSEDEAGRSLEARSLRPAWPPWQNPISTKNAKIS

SEQ ID NO: 742830 - protein, 114 aa, Homo sapiens
MDGEEKTYGGCEGPDAMYVKLISSDGHEFIVKREHALTSGTIKAMLSGPGQFAENETNEVNFREIPSHVLSKVCMYFTYKVRYTNSSTEIPEFPIAPEIALELLMGAKLRGTEL

SEQ ID NO: 742831 - protein, 90 aa, Homo sapiens; identical to SEQ ID NO: 742823

SEQ ID NO: 742832 - protein, 133 aa, Homo sapiens
MERRKPMVAVKDLMPCMSKIGIFILDWAMKLYWLKTRRTIAIKHSRARTKKGPMLGVGPGQVWLRNGKPNERQPFSRRLPFDVAYSGTGLLQLFILYRYPRVPAYKLNQASHRKNSVKISANLATLNIGHWKL

SEQ ID NO: 742833 - protein, 105 aa, Homo sapiens
GEARGVRAAASRCGRSGQARGVCRTSAHDLPRWEVRAAGQALTATWPRGPSPQARFSGEATAWPPVLISPPRRPRPSRCSPTACSPRRATSTIVGGRTAAGTESA

SEQ ID NO: 742834 - protein, 126 aa, Homo sapiens
ACPNPCYRPHHPPPHPGWEPTVQQLSKPQPLAFPLVGCGRGELPLDSSRAPRPLPLTQTNGHSPLEGAPHAALAWGSPPVGSHPRISQRLCTGKLGIAMKVLGGVALFWIIFILGYLTGYYVHKCK

SEQ ID NO: 742835 - protein, 131 aa, Homo sapiens
VRRAGSGLRLPGAAAVGRCDCARPRWLRTGGGGGVPWTDPHRPNPRCGARAGTARPAPCPAPCGCWGPPTPATFPSRPLARSASPVTFIFLGSRRLPHLSPRPAPLGGAGRWPGPDRNLAQRPQPSGKVLR

SEQ ID NO: 742836 - protein, 131 aa, Homo sapiens; identical to SEQ ID NO: 742835

SEQ ID NO: 742837 - protein, 90 aa, Homo sapiens
THMCVCTDSLASTKNQVLGYSLHGSSCLVTIAIAAVLVANEITQYTLAPRFELQEMRHFPQRAIKFGIPFPWSDITLEYSSSGSLQTTSS

SEQ ID NO: 742838 - protein, 103 aa, Homo sapiens
HTPLTPSSVLTPGRQSTCRRRVHISEGRKEHKANADHKTAPRKRREAPPFREFHSQDVASEKDRPDARTPELLPSTDSCKPGHTHSTEPRLTPRSLDFTITGA

SEQ ID NO: 742839 - protein, 236 aa, Homo sapiens
SPPVFPEHLTMCTGKCARCVGLSLITLCLVCIVANALLLVPNGETSWTNTNHLSLQVWLMGGFIGGGLMVLCPGIAAVRAGGKGCCGAGCCGNRCRMLRSVFSSAFGVLGAIYCLSVSGAGLRNGPRCLMNGEWGYHFEDTAWFSLYSCPPFSASSLPPFPRGLGHLGGTRLRGHSLHVGYLGLSKSPGTYSWGRGGARARCLLPRGLTPPTGELTCSTALYGIGARRPLAWSPGM

SEQ ID NO: 742840 - protein, 207 aa, Homo sapiens
SPPVFPEHLTMCTGKCARCVGLSLITLCLVCIVANALLLVPNGETSWTNTNHLSLQVWLMGGFIGGGLMVLCPGIAAVRAGGKGCCGAGCCGNRCRMLRSVFSSAFGVLGAIYCLSVSGAGLRNGPRCLMNGEWGYHFEDTAGAYLLNRTLWDRCEAPPRVVPWNVTLFSLLVAASCLEIVLCGIQLVNATIGVFCGDCRKKQDTPH

SEQ ID NO: 742841 - protein, 120 aa, Homo sapiens
RSAGVMAASAHGSVWGPLRLGIPGLCCRRPPLGLYARMRRLPGPEVSGRSVAAASGPGAWGTDHYCLELLRKRDYEGYLCSLLLPAESRSSVFALRAFNVELAQADYSCCCLAVLYATGI

SEQ ID NO: 742842 - protein, 222 aa, Homo sapiens
MRMQFWKKTVEDIYCDNPPHQPVAIELWKAVKRHNLTKRWLMKIVDEREKNLDDKAYRNIKELENYAENTQSSLLYLTLEILGIKDLHADHAASHIGKAQGIVTCLRATPYHGSRRKVFLPMDICMLHGVSQEDFLRRNQDKNVRDVIYDIASQAHLHLKHARSFHKTVPVKAFPAFLQTVSLEDFLKKIQRVDFDIFHPSLQQKNTLLPLYLYIQSWRKTY

SEQ ID NO: 742843 - protein, 103 aa, Homo sapiens
MEPGPTCCRNRHREPAGLAARSGFRLPIGEAQGTARPGLKAERSAGSGASAPADNKRTGRERPPPQALQPSSHVTQELSPSVLFAYLQIVGIHAGTANSPGYL

SEQ ID NO: 742844 - protein, 403 aa, Homo sapiens
RSAGVMAASAHGSVWGPLRLGIPGLCCRRPPLGLYARMRRLPGPEVSGRSVAAASGPGAWGTDHYCLELLRKRDYEGYLCSLLLPAESRSSVFALRAFNVELAQAVKDSVSEKTIGLMRMQFWKKTVEDIYCDNPPHQPVAIELWKCCQKRVSVTGATHRPDSGTPLLRSAHQQRQAQFLGPRLTSQSPSKDGKPEPPNWGLRRKSGWEAAVKRHNLTKRWLMKIVDEREKNLDDKAYRNIKELENYAENTQSSLLYLTLEILGIKDLHADHAASHIGKAQGIVTCLRATPYHGSRRKVFLPMDICMLHGVSQEDFLRRNQDKNVRDVIYDIASQAHLHLKHARSFHKTVPVKAFPAFLQTVSLEDFLKKIQRVDFDIFHPSLQQKNTLLPLYLYIQSWRKTY

SEQ ID NO: 742845 - protein, 103 aa, Homo sapiens; identical to SEQ ID NO: 742843

SEQ ID NO: 742846 - protein, 127 aa, Homo sapiens
PGQVRLCSPQSRSATTRSPLRRPCAARPGKAFPARPPRTVLEKVLKAYPPTDDPETVPAQSLLLLTLAPAQGWRLSTGLVLHGGLFFGLSDMVPALLESAGVQHNRWWSVVTSAQAVREEWLVAMES

SEQ ID NO: 742847 - protein, 339 aa, Homo sapiens
RSAGVMAASAHGSVWGPLRLGIPGLCCRRPPLGLYARMRRLPGPEVSGRSVAAASGPGAWGTDHYCLELLRKRDYEGYLCSLLLPAESRSSVFALRAFNVELAQAVKDSVSEKTIGLMRMQFWKKTVEDIYCDNPPHQPVAIELWKAVKRHNLTKRWLMKIVDEREKNLDDKAYRNIKELENYAENTQSSLLYLTLEILGIKDLHADHAASHIGKAQGIVTCLRATPYHGSRRKVFLPMDICMLHGVSQEDFLRRNQDKNVRDVIYDIASQAHLHLKHARSFHKTVPVKAFPAFLQTVSLEDFLKKIQRVDFDIFHPSLQQKNTLLPLYLYIQSWRKTY

SEQ ID NO: 742848 - protein, 222 aa, Homo sapiens; identical to SEQ ID NO: 742842

SEQ ID NO: 742849 - protein, 222 aa, Homo sapiens; identical to SEQ ID NO: 742842

SEQ ID NO: 742850 - protein, 81 aa, Homo sapiens
LAKCGSALPSPGPRPPGARSAGLARRAQGRHFQPAHPGLFFGLSDMVPALLESAGVQHNRWWSVVTSAQAVREEWLVAMES

SEQ ID NO: 742851 - protein, 76 aa, Homo sapiens
NLFSLGVLSLLECKLSTSSCTCLNIHKSDNECKESENSIEDISLPERTAMPRSIVRAHTVNSLNKKVQTRHVTWAL

SEQ ID NO: 742852 - protein, 108 aa, Homo sapiens
MQFLWTVYKREAPHVVPYGQCVTLGEQVGWQDRRPQAGRRRHSQVLSSTPAGDLPARPRSVPDDGSPVTLPALPSFAPMSACPQPQCCRLTYLSPRPALFFPTPRGRS

SEQ ID NO: 742853 - protein, 293 aa, Homo sapiens
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 742854 - protein, 448 aa, Homo sapiens
NHQVGHLPYRHPEVPVDIKTSAPSEAPGLRSGQRGGRGQGEGAAKERRTARGGQGASLPRQGPPQPSRRLDRGIVLRRRPSSGPAPAPPRACYWRKVPGRAATGRHAAGPAPFPTRSKAAPALGLRGRRSGRGLGGFAGAGGGESPDSPDAARRAMGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 742855 - protein, 223 aa, Homo sapiens
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVSPPWGEPGACLPLNAYRSHMPPHSNSRDHPWGHP

SEQ ID NO: 742856 - protein, 223 aa, Homo sapiens; identical to SEQ ID NO: 742855

SEQ ID NO: 742857 - protein, 197 aa, Homo sapiens
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFGGWGPLLWR

SEQ ID NO: 742858 - protein, 293 aa, Homo sapiens; identical to SEQ ID NO: 742853

SEQ ID NO: 742859 - protein, 115 aa, Homo sapiens [sequence omitted]

SEQ ID NO: 742860 - protein, 308 aa, Homo sapiens
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVEGGAHCFGGDGTINKNSVHAKKKKKKKKKKKKKKTKGGRKKNTPEGGPKKSENPNVCMVHKEGDDQKERNGNIKANGRKERTVTTHRSKSEKKVHKQE

SEQ ID NO: 742861 - protein, 358 aa, Homo sapiens
MGAVWSALLVGGGLAGALFVWLLRGGPGDTGKDGDAEQEKDAPLGGAAIPGGHQSGSSGLSPGPSGQELVTKPEHLQESNGHLISKTKDLGKLQAASWRLQNPSREVCDNSREHVPSGQFPDTEAPATSETSNSRSYSEVSRNESLESPMGEWGFQKGQEISAKAATCFAEKLPSSNLLKNRAKEEMSLSDLNSQDRVDHEEWEMVPRHSSWGDVGVGGSLKAPVLNLNQGMDNGRSTLVEARGQQVHGKMERVAVMPAGSQQVSVRFQVHYVTSTDVQFIAVTGDHECLGRWNTYIPLHYNKDGFWSHSIFLPADTVVEWKFVLVENGGVTRWEECSNRFLETGHEDKVVHAWWGIH

SEQ ID NO: 742862 - protein, 366 aa, Homo sapiens
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENVCKAVSDFCKWVTTFGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQSIFKKAMDI

SEQ ID NO: 742863 - protein, 165 aa, Homo sapiens
MGAVWSALLVGGGLAGALFVWLLRGGPGDTGKDGDAEQEKDAPLGGAAIPGGHQSGSSGLSPGPSGQELVTKPGILPPVTPGHICQSFEVHRGREQRDKPTWSFPRGPFLRTGSPKGTGPSPRPSVSQAGWYAQAGFLSGPPRAAPLPSPSAPAPEDLVLPLRRG

SEQ ID NO: 742864 - protein, 358 aa, Homo sapiens; identical to SEQ ID NO: 742861

SEQ ID NO: 742865 - protein, 408 aa, Homo sapiens
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENVCKAVSDFCKWVTTFGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQEELLADLHGTVAFKDFILSRGYRMPRFLENMYIGKECKRACNKTPIKRTQA

SEQ ID NO: 742866 - protein, 240 aa, Homo sapiens
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENVCKAVSDFCKWVTTFVS

SEQ ID NO: 742867 - protein, 258 aa, Homo sapiens
SGDQPFDPAADFLFFWGTVFLITTTLVALLKKENEVSVVKEETQGITDTYKLLFAIIKMPAVLTFCLLILTAKIGFSAADAVTGLKLVEEGVPKEHLALLAVPMVPLQIILPLIISKYTAGPQPLNTFYKAMPYRLLLGLEYALLVWWTPKVEHQGGFPIYYYIVVLLSYALHQVTVYSMYVSIMAFNAKVSDPLIGGTYMTLLNTVSNLGGNWPSTVALWLVDPLTVKECVGASNQNCRTPDAVELCKKGADWILKR

SEQ ID NO: 742868 - protein, 549 aa, Homo sapiens
MSPTISHKDSSRQRRPGNFSHSLDMKSGPLPPGGWDDSHLDSAGREGDREALLGDTGTGDFLKAPQSFRAELSSILLLLFLYVLQGIPLGLAGSIPLILQSKNVSYTDQAFFSFVFWPFSLKLLWAPLVDAVYVKNFGRRKSWLVPTQYILGLFMIYLSTQVDRLLGNTDDRTPDVIALTVAFFLFEFLAATQDIAVDGWALTMLSRENVGYASTCNSVGQTAGYFLGNVLFLALESADFCNKYLRFQPQPRGIVTLSDFLFFWGTVFLITTTLVALLKKENEVSVVKEETQGITDTYKLLFAIIKMPAVLTFCLLILTAKIGFSAADAVTGLKLVEEGVPKEHLALLAVPMVPLQIILPLIISKYTAGPQPLNTFYKAMPYRLLLGLEYALLVWWTPKVEHQGGFPIYYYIVVLLSYALHQVTVYSMYVSIMAFNAKVSDPLIGGTYMTLLNTVSNLGGNWPSTVALWLVDPLTVKECVGASNQNCRTPDAVELCKKLGGSCVTALDGYYVESIICVFIGFGWWFFLGPKFKKLQDEGSSSWKCKRNN

SEQ ID NO: 742869 - protein, 549 aa, Homo sapiens; identical to SEQ ID NO: 742868

SEQ ID NO: 742870 - protein, 549 aa, Homo sapiens; identical to SEQ ID NO: 742868

SEQ ID NO: 742871 - protein, 448 aa, Homo sapiens
MSPTISHKDSSRQRRPGNFSHSLDMKSGPLPPGGWDDSHLDSAGREGDREALLGDTGTGDFLKAPQSFRAELSSILLLLFLYVLQGIPLGLAGSIPLILQSKNVSYTDQAFFSFVFWPFSLKLLWAPLVDAVYVKNFGRRKSWLVPTQYILGLFMIYLSTQVDRLLGNTDDRTPDVIALTVAFFLFEFLAATQDIAVDGWALTMLSRENVGYASTCNSVGQTAGYFLGNVLFLALESADFCNKYLRFQPQPRGIVTLSDFLFFWGTVFLITTTLVALLKKENEVSVVKEETQGITDTYKLLFAIIKMPAVLTFCLLILTAKVTVYSMYVSIMAFNAKVSDPLIGGTYMTLLNTVSNLGGNWPSTVALWLVDPLTVKECVGASNQNCRTPDAVELCKKLGGSCVTALDGYYVESIICVFIGFGWWFFLGPKFKKLQDEGSSSWKCKRNN

SEQ ID NO: 742872 - protein, 506 aa, Homo sapiens
MSPTISHKDSSRQRRPGNFSHSLDMKSGPLPPGGWDDSHLDSAGREGDREALLGDTGTGDFLKAPQSFRAELSSILLLLFLYVLQGIPLGLAGSIPLILQSKNVSYTDQAFFSFVFWPFSLKLLWAPLVDAVYVKNFGRRKSWLVPTQYILGLFMIYLSTQVDRLLGNTDDRTPDVIALTVAFFLFEFLAATQDIAVDGWALTMLSRENVGYASTCNSVGQTAGYFLGNVLFLALESADFCNKYLRFQPQPRGIVTLSDFLFFWGTVFLITTTLVALLKKENEVSVVKEETQGITDTYKLLFAIIKMPAVLTFCLLILTAKIGFSAADAVTGLKLVEEGVPKEHLALLAVPMVPLQIILPLIISKYTAGPQPLNTFYKAMPYRLLLGLEYALLVWWTPKVEHQGGFPIYYYIVVLLSYALHQVTVYSMYVSIMAFNAKVSDPLIGGTYMTLLNTVSNLGGNWPSTVALWLVDPLTVKECVGASNQNCRTPDAVELCKKGADWILKR

SEQ ID NO: 742873 - protein, 549 aa, Homo sapiens; identical to SEQ ID NO: 742868

SEQ ID NO: 742874 - protein, 549 aa, Homo sapiens; identical to SEQ ID NO: 742868

SEQ ID NO: 742875 - protein, 549 aa, Homo sapiens; identical to SEQ ID NO: 742868

SEQ ID NO: 742876 - protein, 194 aa, Homo sapiens
CFYIADWFFSSRCCNRTEIGRRGSTQRTFSLIGSSNGSFADNTASDYQQIHCRSPAIKHILQSHALQVTVYSMYVSIMAFNAKVSDPLIGGTYMTLLNTVSNLGGNWPSTVALWLVDPLTVKECVGASNQNCRTPDAVELCKKLGGSCVTALDGYYVESIICVFIGFGWWFFLGPKFKKLQDEGSSSWKCKRNN

SEQ ID NO: 742877 - protein, 448 aa, Homo sapiens; identical to SEQ ID NO: 742871

SEQ ID NO: 742878 - protein, 448 aa, Homo sapiens; identical to SEQ ID NO: 742871

SEQ ID NO: 742879 - protein, 225 aa, Homo sapiens
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 742880 - protein, 1616 aa, Homo sapiens
GHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLVRARRARGQRRRALGQAAGTGFGSPAAPFPEPPPAFSPQAPASTSR

SEQ ID NO: 742881 - protein, 1577 aa, Homo sapiens
GHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLAPASTSR

SEQ ID NO: 742882 - protein, 458 aa, Homo sapiens
AGGYPRGYLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRSVGLRPGKLGQECCWTSWRGRGVASRALPHRRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLAPASTSR

SEQ ID NO: 742883 - protein, 355 aa, Homo sapiens
SSSSPYYRLWKDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLAPASTSR

SEQ ID NO: 742884 - protein, 978 aa, Homo sapiens
GHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGTHCPMPPSDACPQEAAQKVQENQGD

SEQ ID NO: 742885 - protein, 1577 aa, Homo sapiens; identical to SEQ ID NO: 742881

SEQ ID NO: 742886 - protein, 179 aa, Homo sapiens
RWSAIADAASCRESPHCGPLLCTMSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 742887 - protein, 123 aa, Homo sapiens
RWSAIADAASCRESPHCGPLLCTMSGGLLKALRSDSYVELSQYRDQHFRGDNEEQEKLLKKSCTLYVGNLSFYTTEEQIYELFSKSGDIKKIIMGLDKMKKTACGFCFVEYPSHGSNVAAEPG

SEQ ID NO: 742888 - protein, 77 aa, Homo sapiens
RWSAIADAASCRESPHCGPLLCTMSGGLLKALRSDSYVELSQYRDQHFRVREAGPRDGKALGKNAEKRVTMKNKKNY

SEQ ID NO: 742889 - protein, 138 aa, Homo sapiens
MVLRKLYAGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 742890 - protein, 76 aa, Homo sapiens
RWSAIADAASCRESPHCGPLLCTMSGGLLKALRSDSYVELSQYRDQHFRGDNEEQEKLLKKSYITHAQMRKTPCGT

SEQ ID NO: 742891 - protein, 145 aa, Homo sapiens
MNNESIYLKHKGHDFVYLVGNACFLTQLEERPLYELFSPEWCTIMEDISGVRFWSIYASKRHAILDLWIFVLYSLTYYSRADAENAMRYINGTRLDDRIIRTDWDAGFKEGRQYGRGRSGGQVRDEYRQDYDAGRGGYGKLAQNQ

SEQ ID NO: 742892 - protein, 179 aa, Homo sapiens; identical to SEQ ID NO: 742886

SEQ ID NO: 742893 - protein, 179 aa, Homo sapiens; identical to SEQ ID NO: 742886

SEQ ID NO: 742894 - protein, 199 aa, Homo sapiens
RWSAIADAASCRESPHCGPLLCTMSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLALWPVEFAEEHHLKSAHEPIFTKI

SEQ ID NO: 742895 - protein, 179 aa, Homo sapiens; identical to SEQ ID NO: 742886

SEQ ID NO: 742896 - protein, 76 aa, Homo sapiens; identical to SEQ ID NO: 742890

SEQ ID NO: 742897 - protein, 569 aa, Homo sapiens
MGSTLGCHRSIPRDPSDLSHSRKFSAACNFSNILVNQERLNINTATEEELMTLPGVTRAVARSIVEYREYIGGFKKVEDLALVSGVGATKLEQVKFEICVSSKGSSAQHSPSSLRRDLLAEQQPHHLATAVPLTPRVNINTATPAQLMSVRGLSEKMALSIVDFRREHGPFRSVEDLVRMDGINAAFLDRIRHQVFAERSRPPSTHTNGGLTFTAKPHPSPTSLSLQSEDLDLPPGGPTQIISTRPSVEAFGGTRDGRPVLRLATWNLQGCSVEKANNPGVREVVCMTLLENSIKLLAVQELLDREALEKFCTELNQPTLPNIRKWKGPRGCWKAVVAEKPSNQLQKGAGYAGFLWDAAAGMELRDAGSQESSPSNGHGKLAGPSPYLGRFKVGSHDLTLVNLHLAALTLLGSENPSKNHSDGHRLASFAQTLQETLKGEKDVIILGDFGQGPDSNDYDILRKEKFHHLIPAHTFTNISTKNPQGSKSLDNIWISKSLKKVFTGHWAVVREGLTNPWIPDNWSWGGVASEHCPVLAEFYTEKDWSKKDAPRNGSGVALERSEANIKHER

SEQ ID NO: 742898 - protein, 569 aa, Homo sapiens; identical to SEQ ID NO: 742897

SEQ ID NO: 742899 - protein, 289 aa, Homo sapiens
MQCLASQAAASRDCFRREPTLLTCALSLQFFCTELNQPTLPNIRKWKGPRGCWKAVVAEKPSNQLQKGAGYAGFLWDAAAGMELRDAGSQESSPSNGHGKLAGPSPYLGRFKVGSHDLTLVNLHLAALTLLGSENPSKNHSDGHRLASFAQTLQETLKGEKDVIILGDFGQGPDSNDYDILRKEKFHHLIPAHTFTNISTKNPQGSKSLDNIWISKSLKKVFTGHWAVVREGLTNPWIPDNWSWGGVASEHCPVLAEFYTEKDWSKKDAPRNGSGVALERSEANIKHER

SEQ ID NO: 742900 - protein, 569 aa, Homo sapiens; identical to SEQ ID NO: 742897

SEQ ID NO: 742901 - protein, 398 aa, Homo sapiens
RGSQPRPIDVQTLNRNPGSCRHWHSYSEGLGHPRVSQVTFPPPQEAMTEAGKLPLPLPPRLDWFVHTQMGQLAQDGVPEWFHGAISREDAENLLESQPLGSFLIRVSHSHVGYTLSYKAQSSCCHFMVKLLDDGTFMIPGEKVAHTSLDALVTFHQQKPIEPRRELLTQPCRQKDPANVDYEDLFLYSNAVAEEAACPVSAPEEASPKPVLCHQSKERKPSAEMNRITTKEATSSCPPKSPLGETRQKLWRSLKMLPERGQRVRQQLKSHLATVNLSSLLDVRRSTVISGPGTGKGSQDHSGDPTSGDRGYTDPCVATSLKSPSQPQAPKDRKVPTRKAERSVSCIEVTPGDRSWHQMVVRALSSQESKPEHQGLAEPENDQLPEEYQQPPPFAPGYC

SEQ ID NO: 742902 - protein, 358 aa, Homo sapiens
QGGHPKVSQVTFPPPQEAMTEAGKLPLPLPPRLDWFVHTQMGQLAQDGVPEWFHGAISREDAENLLESQPLGSFLIRVSHSHVGYTLSYKAQSSCCHFMVKLLDDGTFMIPGEKVAHTSLDALVTFHQQKPIEPRRELLTQPCRQKDPANVDYEDLFLYSNAVAEEAACPVSAPEETESCFVDQAGVEWHSLGSLQPPPPRFKRFSCLSLLSSWDYSLPKASPVSPIKGKEAVSRDEQNNHQGSHFLLPPKIPSWRDPPETLEEPQNAPRERPEGPAAAKKPPRHCELVVTLGCPEIHGDLRPWDRKRQPRSLRGSHLGGQRLHGSLCGHISQKPLTAPGTKRQKGPHQEGREVGQLH

SEQ ID NO: 742903 - protein, 501 aa, Homo sapiens
FPPFSTQVTFPPPQEAMTEAGKLPLPLPPRLDWFVHTQMGQLAQDGVPEWFHGAISREDAENLLESQPLGSFLIRVSHSHVGYTLSYKKAWAGIQGRGRWALGFPWRGQGVLHVIASQKAAVTEAVDLRTGAASQAMSEAFVRSGMFYLRPAFVLLCYKWGKLRHSEVSNLLGVAWPVSEEACMGTWGSLAVAVTLPAQGLGTWGRDEGEWMSQPPQCLRRAQSSCCHFMVKLLDDGTFMIPGEKVAHTSLDALVTFHQQKPIEPRRELLTQPCRQKDPANVDYEDLFLYSNAVAEEAACPVSAPEEASPKPVLCHQSKERKPSAEMNRITTKEATSSCPPKSPLGETRQKLWRSLKMLPERGQRVRQQLKSHLATVNLSSLLDVRRSTVISGPGTGKGSQDHSGDPTSGDRGYTDPCVATSLKSPSQPQAPKDRKVPTRKAERSVSCIEVTPGDRSWHQMVVRALSSQESKPEHQGLAEPENDQLPEEYQQPPPFAPGYC

SEQ ID NO: 742904 - protein, 398 aa, Homo sapiens; identical to SEQ ID NO: 742901

SEQ ID NO: 742905 - protein, 310 aa, Homo sapiens
FPPFSTQVTFPPPQEAMTEAGKLPLPLPPRLDWFVHTQMGQLAQDGVPEWFHGAISREDAENLLESQPLGSFLIRVSHSHVGYTLSYKKAWAGIQGRGRWALGFPWRGQGVLHVIASQKAAVTEAVDLRTGAASQAMSEAFVRSGMFYLRPAFVLLCYKWGKLRHSEVSNLLGVAWPVSEEACMGTWGSLAVAVTLPAQGLGTWGRDEGEWMSQPPQCLRRAQSSCCHFMVKLLDDGTFMIPGEKVAHTSLDALVTFHQQKPIEPRRELLTQPCRQKDPANVDYEDLFLYSNAVAEEAACPVSAPEEVCI

SEQ ID NO: 742906 - protein, 179 aa, Homo sapiens
QGGHPKVSQVTFPPPQEAMTEAGKLPLPLPPRLDWFVHTQMGQLAQDGVPEWFHGAISREDAENLLESQPLGSFLIRVSHSHVGYTLSYKAQSSCCHFMVKLLDDGTFMIPGEKVAHTSLDALVTFHQQKPIEPRRELLTQPCRQKDPANVDYEDLFLYSNAVAEEAACPVSAPEEVCI

SEQ ID NO: 742907 - protein, 74 aa, Homo sapiens
ENCPGARPGGDEIPGDEAAIAQRDTWGWEVQGQDAGRDVGASLSSIRGREWRGLCQRVSGEGEVGTAQRSQWAG

SEQ ID NO: 742908 - protein, 123 aa, Homo sapiens
GLYVELQGQRHLGSTLLRTRSKSPVRTHIQAASTSALPQERGSLLHVGKSCPCFPSGQLGVWSLGSKVKHTLLLPSFPAVETGVLLCCPGWSQTPGFKQSFHFGLPKCWDYRHEPPCPASFSY

SEQ ID NO: 742909 - protein, 152 aa, Homo sapiens
DYHAKRQQISAFSSLQNTWTIQSSISLLFRMKSVYNIRPLTPQYVRLFLVAGNFFRIQKLLMEASVFVIKEGAVCGIARPKTSRVNSSQDQIQVASENTHSGSLHQRPASGARLPASCGQELPLFSQRAVGGLEPRKQSEAHTPASFLPCSW

SEQ ID NO: 742910 - protein, 105 aa, Homo sapiens [sequence omitted]

SEQ ID NO: 742911 - protein, 252 aa, Homo sapiens
MSGRRTRSGGAAQRSGPRAPSPTKPLRRSQRKSGSELPSILPEIWPKTPSAAAVRKPIVLKRIVAHAVEVPAVQSPRRSPRISFFLEKENEPPGRELTKEDLFKTHSVPATPTSTPVPNPEAESSSKEGELDARDLEMSKKVRRSYSRLETLGSASTSTPGRRSCFGFEGLLGAEDLSGVSPVVCSKLTEVPRVCAKPWAPDMTLPGISPPPEKQKRKKKKMPEILKTELDEWAAAMNAEFEAAEQFDLLVE

SEQ ID NO: 742912 - protein, 252 aa, Homo sapiens; identical to SEQ ID NO: 742911

SEQ ID NO: 742913 - protein, 252 aa, Homo sapiens; identical to SEQ ID NO: 742911

SEQ ID NO: 742914 - protein, 252 aa, Homo sapiens; identical to SEQ ID NO: 742911

SEQ ID NO: 742915 - protein, 252 aa, Homo sapiens; identical to SEQ ID NO: 742911

SEQ ID NO: 742916 - protein, 115 aa, Homo sapiens
MSKKVRRSYSRLETLGSASTSTPGRRSCFGFEGLLGAEDLSGVSPVVCSKLTEVPRVCAKPWAPDMTLPGISPPPEKQKRKKKKMPEILKTELDEWAAAMNAEFEAAEQFDLLVE

SEQ ID NO: 742917 - protein, 123 aa, Homo sapiens
MSGRRTRSGGAAQRSGPRAPSPTKPLRRSQRKSGSELPSILPEIWPKTPSAAAVRKPIVLKRIVAHAVEVPAVQSPRRSPRAAGPALASRGCWGQKTCPESRQWCAPNSPRSPGFVQSPGPQT

SEQ ID NO: 742918 - protein, 252 aa, Homo sapiens; identical to SEQ ID NO: 742911

SEQ ID NO: 742919 - protein, 105 aa, Homo sapiens [sequence omitted]

SEQ ID NO: 742920 - protein, 69 aa, Homo sapiens
KALYGRSNRWNTCAVAITNRDDVLCKNINETHEKKSALILVFAGLLLAFECVCSSVSSSFRVVMLGCQF

SEQ ID NO: 742921 - protein, 105 aa, Homo sapiens [sequence omitted]

SEQ ID NO: 742922 - protein, 129 aa, Homo sapiens
MSGRRTRSGGAAQRSGERRARGRREVEPFGGRSPVKDGLFPPAAAAGGGALKRACLGIFSLSLEPVLWTLRSRVLLYHLTFFSFQGQGPHLLLSLCGGPSGNQALNSRASSLKSGRRHPVRLQSESPSS

SEQ ID NO: 742923 - protein, 396 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 742924 - protein, 355 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIESCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 742925 - protein, 245 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIETCKKALQPSRREPAGRGAPGHGHAGLPARHAHLPVQGPSGPCTVADADPAVPVRQLPTTPAGKQFCVHPHPAGWPLSHQDTTVLQGGRQLQEP

SEQ ID NO: 742926 - protein, 367 aa, Homo sapiens
ERPPGQVESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIESCLEFSLRIQEFIELIRQNKRLDAVRHARKHFSQAEGSQLDEVRQAMGMLAFPPDTHISPYKDLLDPARWRNLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 742927 - protein, 107 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKVGPAWRSLFSLGHGHPFCLENES

SEQ ID NO: 742928 - protein, 389 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPYPTSRAQCRLAWGWHLWITILHTLTSALCHSLSFPPQTSPELSVCCTCVVSGWSGWGRVEGPRMRRAAFTLGSGALPLSSSQRPPWALI

SEQ ID NO: 742929 - protein, 396 aa, Homo sapiens; identical to SEQ ID NO: 742923

SEQ ID NO: 742930 - protein, 396 aa, Homo sapiens; identical to SEQ ID NO: 742923

SEQ ID NO: 742931 - protein, 286 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKTCKKALQPSRREPAGRGAPGHGHAGLPARHAHLPVQGPSGPCTVADADPAVPVRQLPTTPAGKQFCVHPHPAGWPLSHQDTTVLQGGRQLQEP

SEQ ID NO: 742932 - protein, 396 aa, Homo sapiens; identical to SEQ ID NO: 742923

SEQ ID NO: 742933 - protein, 331 aa, Homo sapiens
ERPPGQVESAAQLSMTLKVQEYPTLKVPYETLNKRFRAAQKNIDRETSHVTMVVAELEKTLSGCPAVDSVVSLLDGVVEKLSVLKRKDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 742934 - protein, 239 aa, Homo sapiens
MNETQAPSLVPSLWNSGREGWRACPLPVPRCQQNVPAGWLLSCLERLRGRGEGGGRRSHSVPVVLVLEAGVRRRRLLVSTEASVGLFSCRVQHFLCLERQPRVVSMAPTYQKGTQPRAEWPQGAGLTPAALSGPQPFLDPMLRQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 742935 - protein, 389 aa, Homo sapiens; identical to SEQ ID NO: 742928

SEQ ID NO: 742936 - protein, 196 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCHVPGVPVLPKQYPPRVVA

SEQ ID NO: 742937 - protein, 348 aa, Homo sapiens
MVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 742938 - protein, 348 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIESCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPYPTSRAQCRLAWGWHLWITILHTLTSALCHSLSFPPQTSPELSVCCTCVVSGWSGWGRVEGPRMRRAAFTLGSGALPLSSSQRPPWALI

SEQ ID NO: 742939 - protein, 392 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNVRGAGQGGQAGTHRHRDRAVWDGQGRG

SEQ ID NO: 742940 - protein, 70 aa, Homo sapiens
ERPPGQVESAAQLSMTLKVQEYPTLKNIPAWKPRCARPLHWPQKPHLSAEEPGCCLEWVSSTAWQHSHAS

SEQ ID NO: 742941 - protein, 370 aa, Homo sapiens
MAQGWAGFSEEELRRLKQTKDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELLQEKSRWEVLQQEQRLMEEKNKRKKALLAKAIAERSKRTQAETMKLKRIQKELQALDDMVSADIGILRNRIDQASLDYSYARKRFDRAEAEYIAAKLDIQRKTEIKEQLTEHLCTIIQQNELRKAKKLEELMQQLDVEADEETLELEVEVERLLHEQEVESRRPVVRLERPFQPAEESVTLEFAKENRKCQEQAVSPKVDDQCGNSSSIPFLSPNCPNQEGNDISAALAT

SEQ ID NO: 742942 - protein, 77 aa, Homo sapiens
MEEKNKRKKALLAKAIAERSKRTQAETMKLKRIQKELQALDDMVSADIGILRNRIDQASLDYSYARELGKLNLNKEY

SEQ ID NO: 742943 - protein, 214 aa, Homo sapiens
MEEKNKRKKALLAKAIAERSKRTQAETMKLKRIQKELQALDDMVSADIGILRNRIDQASLDYSYARKRFDRAEAEYIAAKLDIQRKTEIKEQLTEHLCTIIQQNELRKAKKLEELMQQLDVEADEETLELEVEVERLLHEQEVESRRPVVRLERPFQPAEESVTLEFAKENRKCQEQAVSPKVDDQCGNSSSIPFLSPNCPNQEGNDISAALAT

SEQ ID NO: 742944 - protein, 214 aa, Homo sapiens; identical to SEQ ID NO: 742943

SEQ ID NO: 742945 - protein, 214 aa, Homo sapiens; identical to SEQ ID NO: 742943

SEQ ID NO: 742946 - protein, 214 aa, Homo sapiens; identical to SEQ ID NO: 742943

SEQ ID NO: 742947 - protein, 370 aa, Homo sapiens; identical to SEQ ID NO: 742941

SEQ ID NO: 742948 - protein, 370 aa, Homo sapiens; identical to SEQ ID NO: 742941

SEQ ID NO: 742949 - protein, 140 aa, Homo sapiens
SSIFFYIDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELLVSLCEKSMRLFI

SEQ ID NO: 742950 - protein, 340 aa, Homo sapiens
MLTQLKAKSEGKLAKQICKVVLDHFEKQYSKELGDAWNTVREILTSPSCWQYAVLLNRFNYPFELEKDLHLKGYHTLSQGSLPNYPKSVKCYLSRTPGRIPSERHQIGNLKKYYLLNAASLLPVLALELRDGEKVLDLCAAPGGKSIALLQCACPGYLHCNEYDSLRLRWLRQTLESFIPQPLINVIKVSELDGRKMGDAQPEMFDKVLVDAPCSNDRSWLFSSDSQKASCRISQRRNLPLLQIELLRSAIKALRPGGILVYSTCTLSKAENQDVISEILNSHGNIMPMDIKGIARTCSHDFTFAPTGQECGLLVIPDKGKAWGPMYVAKLKKSWSTGKW

SEQ ID NO: 742951 - protein, 123 aa, Homo sapiens
YGTRPRADSQKASCRISQRRNLPLLQIELLRSAIKALRPGGILVYSTCTLSKAENQDVISEILNSHGNIMPMDIKGIARTCSHDFTFAPTGQECGLLVIPDKGKAWGPMYVAKLKKSWSTGKW

SEQ ID NO: 742952 - protein, 340 aa, Homo sapiens; identical to SEQ ID NO: 742950

SEQ ID NO: 742953 - protein, 322 aa, Homo sapiens
MLTQLKAKSEGKLAKQICKVVLDHFEKQYSKELGDAWNTVREILTSPSCWQYAVLLNRFNYPFELEKDLHLKGYHTLSQGSLPNYPKSVKCYLSRTPGRIPSERHQIGNLKKYYLLNAASLLPVLALELRDGEKVLDLCAAPGGKSIALLQCACPGYLHCNEYDSLRLRWLRQTLESFIPQPLINVIKVSELDGRKMGDAQPEMFDKVLVDAPCSNDRSWLFSSDSQKASCRISQRRNLPLLQIELLRSAIKALRPGGILVYSTCTLSKAVDIKGIARTCSHDFTFAPTGQECGLLVIPDKGKAWGPMYVAKLKKSWSTGKW

SEQ ID NO: 742954 - protein, 1249 aa, Homo sapiens
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPPSERNGTSSTCQDSPEKTTLAAKLSAKKQASIYRDENDDFQVEKKRIRPLETTQQIRKRHCFGTEVHNLDAKVDSGKTVKLNSPLEKINSFSPQKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTPPYLLEAASHLSPENFVEDEAKICVQELQCPKIITKNSPLPSSIISRKEKNDPVFLEEAGKAEKIVISRSTSPTFNKQTKRVSWSSFNSLGQYFTGKIPKATPELGSSENSASSPPRFKTEKMESKTVLPFTDKCESSNLTVNTSFGSCPQSETIISSLKIDATLTRKNHSEHPLCSEEALDPDIELSLVSEEDKQSTSNRDFETEAEDESIYFTPELYDPEDTDEEKNDLAETDRGNRLANNSDCILAKDLFEIRTIKEVDSAREVKAEDCIDTKLNGILHIEESKIDDIDGNVKTTWINELELGKTHEIEIKNFKPSPSKNKGMFPGFK

SEQ ID NO: 742955 - protein, 1048 aa, Homo sapiens
MALHQLVKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTPPYLLEAASHLSPENFVEDEAKICVQELQCPKIITKNSPLPSSIISRKEKNDPVFLEEAGKAEKIVISRSTSPTFNKQTKRVSWSSFNSLGQYFTGKIPKATPELGSSENSASSPPRFKTEKMESKTVLPFTDKCESSNLTVNTSFGSCPQSETIISSLKIDATLTRKNHSEHPLCSEEALDPDIELSLVSEEDKQSTSNRDFETEAEDESIYFTPELYDPEDTDEEKNDLAETDRGNRLANNSDCILAKDLFEIRTIKEVDSAREVKAEDCIDTKLNGILHIEESKIDDIDGNVKTTWINELELGKTHEIEIKNFKPSPSKNKGMFPGFK

SEQ ID NO: 742956 - protein, 630 aa, Homo sapiens
MALHQLVKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGR

SEQ ID NO: 742957 - protein, 651 aa, Homo sapiens
MALHQLVKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQLTSATAEGTNGYAQSWVSYSKMADAALTTATDETVDIYPRNLLSPSTALVLHSTEVECY

SEQ ID NO: 742958 - protein, 630 aa, Homo sapiens; identical to SEQ ID NO: 742956

SEQ ID NO: 742959 - protein, 120 aa, Homo sapiens
RERTDTGQGAGRLGRNEWRGVFLSSAAHPPQHTTHTHTQSNKFLSLKCGRGGPSLSLVGGVVRGRSQGWGRGSETVWGGEVCKSSNSGANGGSSQPTRRAGREGSAWPLPQASPTPTLGA

SEQ ID NO: 742960 - protein, 113 aa, Homo sapiens
MIVSSGCPKSICLEYHSLITLVNLEGIIRSEKRHHSLITRMNLEGIIRSEKRLRSLITRVNLEGITRSEKRPCSLVRRVNPEGITQSGKKTPLTDNAGEPRRNYTEWKKGPAH

SEQ ID NO: 742961 - protein, 828 aa, Homo sapiens
MDESALTLGTIDVSYLPHSSEYSVGRCKHTSEEWGECGFRPTIFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYDRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEGTISLPCQTFYQVCHETVGKFIQYGILTVAEHDDQEDISPSLAEQQWDKKLPEPLSWRSDEEDEDSDFGEEQRDCYLKVSQSKEHQQFITFLQRLLGPLLEAYSSAAIFVHNFSGPVPEPEYLQKLHKYLITRTERNVAVYAESATYCLVKNAVKMFKDIGVFKETKQKRVSVLELSSTFLPQCNRQKLLEYILSFVVL

SEQ ID NO: 742962 - protein, 828 aa, Homo sapiens; identical to SEQ ID NO: 742961

SEQ ID NO: 742963 - protein, 828 aa, Homo sapiens; identical to SEQ ID NO: 742961

SEQ ID NO: 742964 - protein, 828 aa, Homo sapiens; identical to SEQ ID NO: 742961

SEQ ID NO: 742965 - protein, 828 aa, Homo sapiens; identical to SEQ ID NO: 742961

SEQ ID NO: 742966 - protein, 828 aa, Homo sapiens; identical to SEQ ID NO: 742961

SEQ ID NO: 742967 - protein, 828 aa, Homo sapiens; identical to SEQ ID NO: 742961

SEQ ID NO: 742968 - protein, 828 aa, Homo sapiens; identical to SEQ ID NO: 742961

SEQ ID NO: 742969 - protein, 828 aa, Homo sapiens; identical to SEQ ID NO: 742961

SEQ ID NO: 742970 - protein, 828 aa, Homo sapiens; identical to SEQ ID NO: 742961

SEQ ID NO: 742971 - protein, 356 aa, Homo sapiens
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTGKKSHLRKTTEKKLPTKQTIAKLQQSDIWKMENEFYEFALEQFQFIRAHAVREKDGDLYILAQNFFYEKIYPKSN

SEQ ID NO: 742972 - protein, 329 aa, Homo sapiens
KSVGRVPLTEESYDWHQGKVTKSFLYMLFIKFIHLEVFSMPERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTAPDTATPSHRHGPICGSKSISSLLVKVSPVCKDSHCLGKCSRNGLSAV

SEQ ID NO: 742973 - protein, 122 aa, Homo sapiens
RGRSRGALATVLWNSLVFHARSGVLLAPSRHPALPSEARLLAGEGRMLARRDLGLVPHGVSGVSIAASSTPQGQAVCSPSVAAPSTLLLLRTHLLGAASLQGCGVAAPLSRTTQGLDPRALV

SEQ ID NO: 742974 - protein, 128 aa, Homo sapiens
RGRSRGALATVLWNSLVFHARSGVLLAPSRHPALPSEARLLAGEGRMLARRDLGLVPHGVSGVSIAASSTPQGQAVCSPSVAAPSTLLLLRTHLLGAASLQGCGHQILLHHLIGMDLYVAASPSHRFW

SEQ ID NO: 742975 - protein, 350 aa, Homo sapiens
MMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTGKKSHLRKTTEKKLPTKQTIAKLQQSDIWQMENEFYEFALEQFQFIRAHAVREKDGDLYILAQNFFYEKIYPKSN

SEQ ID NO: 742976 - protein, 315 aa, Homo sapiens
MMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTGKKSHLRKTTEKKLPTKQTIAKLQQSDHLGKWRMSSMNLH

SEQ ID NO: 742977 - protein, 315 aa, Homo sapiens; identical to SEQ ID NO: 742976

SEQ ID NO: 742978 - protein, 342 aa, Homo sapiens
MMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTAPDTATPSHRHGPICGSKSISSLLVKVSPVCKDSHCHCRRGTGTPKGETLATLAPCSQSWSSVTHRW

SEQ ID NO: 742979 - protein, 223 aa, Homo sapiens [sequence omitted]

SEQ ID NO: 742980 - protein, 356 aa, Homo sapiens; identical to SEQ ID NO: 742971

SEQ ID NO: 742981 - protein, 444 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742982 - protein, 465 aa, Homo sapiens
MHSSCRQRRNQNLSKEIPQTEFHTGYSMENEPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742983 - protein, 468 aa, Homo sapiens
AGWEVGRRKDGGKLKKLELLPRALSGRSEQGAGQPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742984 - protein, 769 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSASHVTSSTVTSSFDCQLPLHFRTLAITLSPPKFSRVISLFQGQLISILYSPLKLVTYSPIPGIRMWTSLGGHYSALHTYLVPSARNVPFISQPLPLLHLKSYPLCNTHLPRSQSFHSLSVLEVKCAFLRFEIANYSLCHTDLMSFVECSCSVPDPLLVWGSWESCGFTGFRWGVRLPGSDCGFCCVTWAKLCNISDLLPNLQVKTGVIYAWVKGDKAPVTLPGTGVILKDSFCWLWPWVNGTSDQRAAGFAFARIPRRGVCGLKSGKPCPEAHSTFQSAGSLMKDSRVPEDQGCRFSCKYSSGLDSKCLPTMSLKVILVFCIFLTDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742985 - protein, 485 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSASHVTSSTVTSSFDCQLPLHFRTLAITLSPPKFSRVISLFQDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742986 - protein, 444 aa, Homo sapiens; identical to SEQ ID NO: 742981

SEQ ID NO: 742987 - protein, 498 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSEPNSEPCPRGAPGPGQADHPACPVSSPLIIIIITYIPLFKDRDPHTRHGLGFLKRVWDGGSGEATRSHTTFFRSCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742988 - protein, 407 aa, Homo sapiens
MHSSCRQRRNQNLSKEIPQTEFHTGYSMENEYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742989 - protein, 386 aa, Homo sapiens
MEEEGKKGKKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742990 - protein, 410 aa, Homo sapiens
AGWEVGRRKDGGKLKKLELLPRALSGRSEQGAGQYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742991 - protein, 506 aa, Homo sapiens
MHSSCRQRRNQNLSKEIPQTEFHTGYSMENEPGIVSPFKRVFLKGEKSRDKKAHEKVTERRPLHTVVLSLPERVEPDRLLSDYIEKEVKMEFCSCCPGWSIMAQSWLTTTSASRVQAIILPQPPEELRLQYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742992 - protein, 393 aa, Homo sapiens
MVPEEKSSVILVLAILKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742993 - protein, 142 aa, Homo sapiens
MLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742994 - protein, 142 aa, Homo sapiens; identical to SEQ ID NO: 742993

SEQ ID NO: 742995 - protein, 309 aa, Homo sapiens
MEEEGKKGKKPGIVSPFKRVFLKGEKSRDKKAHEKVTERRPLHTVVLSLPERVEPDRLLSDYIEKEVKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742996 - protein, 353 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742997 - protein, 711 aa, Homo sapiens
MEEEGKKGKKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSASHVTSSTVTSSFDCQLPLHFRTLAITLSPPKFSRVISLFQGQLISILYSPLKLVTYSPIPGIRMWTSLGGHYSALHTYLVPSARNVPFISQPLPLLHLKSYPLCNTHLPRSQSFHSLSVLEVKCAFLRFEIANYSLCHTDLMSFVECSCSVPDPLLVWGSWESCGFTGFRWGVRLPGSDCGFCCVTWAKLCNISDLLPNLQVKTGVIYAWVKGDKAPVTLPGTGVILKDSFCWLWPWVNGTSDQRAAGFAFARIPRRGVCGLKSGKPCPEAHSTFQSAGSLMKDSRVPEDQGCRFSCKYSSGLDSKCLPTMSLKVILVFCIFLTDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 742998 - protein, 210 aa, Homo sapiens [sequence omitted]

SEQ ID NO: 742999 - protein, 438 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGSQALQCVPARGGPGRAGRESQSCRLGPWTAVSFAHDVPIVTLRDLKKKFTAM

SEQ ID NO: 743000 - protein, 295 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHMDGGAPTPSAQSS

SEQ ID NO: 743001 - protein, 142 aa, Homo sapiens; identical to SEQ ID NO: 742993

SEQ ID NO: 743002 - protein, 142 aa, Homo sapiens; identical to SEQ ID NO: 742993

SEQ ID NO: 743003 - protein, 268 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTL

SEQ ID NO: 743004 - protein, 370 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSASHVTSSTVTSSFDCQLPLHFRTLAITLSPPKFSRVISLFQGQLISILYSPLKLVTYSPIPGIRMWTSLGGHYSALHTYLVPSARNVPFISQPLPLLHLKSYPLCNTHLPRSQSFHSLSVLG

SEQ ID NO: 743005 - protein, 108 aa, Homo sapiens
VLLAPRLRTRWSWKLRRMGEKMAEEERFPNTTHEGFNVTLHTTLVVTTKLVLPTPGKPILPVQTGEQAQQEEQSSGMTIFFSLLVLGEYGHCHPHHLPSRVCVLGLCV

SEQ ID NO: 743006 - protein, 121 aa, Homo sapiens
VLLAPRLRTRWSWKLRRMGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGKCVLVIP

SEQ ID NO: 743007 - protein, 93 aa, Homo sapiens
KGGTHCFRKVRCAQAMGAAWAASDLQLHNVDFSWEIKIIIRKLPGTGVLSRQEPLPGLGRVWCSLESPGQKQRRRRLQASAFLIDVFLLEQRP

SEQ ID NO: 743008 - protein, 120 aa, Homo sapiens
AQVLKVACSNTLLNNIVLYVATALLGVFPVAGILFSYSQIVSSLMGMSSTKGKYKAFSTCGSHLCVVSLFYGTGLGVYLSSAVTHSSQSSSTASVMYAMVTPMLNPFIYSLRNKDVKGAL

SEQ ID NO: 743009 - protein, 53 aa, Homo sapiens
SLGITARLFLLQEFPNAGTHSPKEFASELPVASWGTDRRNRAISRPCAQRRTD

SEQ ID NO: 743010 - protein, 125 aa, Homo sapiens
MHNILRRLIHNKMSNNIQHILVNPTPSWIHSTQGSIYLTVGKFPTRTAVTVPGPLNNTLTLGIKVNTGPQNVSDPLVRIQLLTCCFSPPTTQILHNKIYIFSTMPGPLQLPQALSSPRALRWGGD

SEQ ID NO: 743011 - protein, 64 aa, Homo sapiens
TCHVTQNKKAEDRDSNSSFNQHDTRHVGIYHETYIYTQIYKISISTSPTASRVSVIFRYTWNIY

SEQ ID NO: 743012 - protein, 116 aa, Homo sapiens
MEFSGEGFDLRELLVSFSPVKFQGFGNVHERALLPSQPSPPLTLPSTGIRVLASDPACSMRPTKGRGLFLSSSSSSCRRCKPKCQQSLSLSCVSWPAGGRMTQSLPTSLVTWPSAG

SEQ ID NO: 743013 - protein, 72 aa, Homo sapiens
EKAETWTLPGGLGGGPVLGRCLSESQVRRIKRPDAVRLPVLGEDGPSLPRELCGIRKRWCSFAFTGLSEIRL

SEQ ID NO: 743014 - protein, 225 aa, Homo sapiens
MAAAGGGGGGAAAAGRAYSFKVVLLGEGCVGKTSLVLRYCENKFNDKHITTLQASFLTKKLNIGGKRVNLAIWDTAGQERFHALGPIYYRDSNGAILVYDITDEDSFQKVKNWVKELRKMLGNEICLCIVGNKIDLEKERHVSIQEAESYAESVGAKHYHTSAKQNKGIEELFLDLCKRMIETAQVDERAKGNGSSQPGTARRGVQIIDDEPQAQTSGGGCCSSG

SEQ ID NO: 743015 - protein, 225 aa, Homo sapiens; identical to SEQ ID NO: 743014

SEQ ID NO: 743016 - protein, 225 aa, Homo sapiens; identical to SEQ ID NO: 743014

SEQ ID NO: 743017 - protein, 225 aa, Homo sapiens; identical to SEQ ID NO: 743014

SEQ ID NO: 743018 - protein, 225 aa, Homo sapiens; identical to SEQ ID NO: 743014

SEQ ID NO: 743019 - protein, 225 aa, Homo sapiens; identical to SEQ ID NO: 743014

SEQ ID NO: 743020 - protein, 184 aa, Homo sapiens
MAAAGGGGGGAAAAGRAYSFKVVLLGEGCVGKTSLVLRYCENKFNDKHITTLQASFLTKKLNIGGKRVNLAIWDTAGQERFHALGPIYYRDSNGAILVYDITDEDSFQKVKNWVKELRKMLGNEICLCIVGNKIDLEKERHVSIQEAESYAESVGAKHYHTSAKQNKGIEELFLDLCKRMIETA

SEQ ID NO: 743021 - protein, 233 aa, Homo sapiens
MGGVLCPLCPPRRVWGEGGEEGERNRGGTAGGRGGVQGEPGVRAPMCGPPRRGRYTGERISHLLHKKTIAGVGTGGLQRPGVFPHDTVGRSARTGRGRNHISWGTREVPKTPRAGAHQSIGVKPPGLNYNKLHKNMYEAGGVGGGTPLIYIPQLSLGGKRKKAQREKNSLVNHPRGGESVLLGDPQENTRHLPPPVVATTERETVFSPQHITKTGAAQILGGGDTKVIERRKV

SEQ ID NO: 743022 - protein, 149 aa, Homo sapiens
MAAAGGGGGGAAAAGRAYSFKVVLLGEGCVGKTSLVLRYCENKFNDKHITTLQASFLTKKLNIGGKRVNLAIWDTAGQERFHALGPIYYRDSNGAILVYDITDEDSFQKVKNWVKELRKMLGNEICLCIVGKHHYFFLKKKSSVSLMFY

SEQ ID NO: 743023 - protein, 954 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDAPVPIIHRDLKSINILILEAIENHNLADTVLKITDFGLAREWHKTTKMSAAGTYAWMAPEVIRLSLFSKSSDVWSFGVLLWELLTGEVPYREIDALAVAYGVAMNKLTLPIPSTCPEPFARLLEECWDPDPHGRPDFGSILKRLEVIEQSALFQMPLESFHSLQEDWKLEIQHMFDDLRTKEKELRSREEELLRAAQEQRFQEEQLRRREQELAEREMDIVERELHLLMCQLSQEKPRVRKRKGNFKRSRLLKLREGGSHISLPSGFEHKITVQASPTLDKRKGSDGASPPASPSIIPRLRAIRLTPVDCGGSSSGSSSGGSGTWSRGGPPKKEELVGGKKKGRTWGPSSTLQKERVGGEERLKGLGEGSKQWSSSAPNLGKSPKHTPIAPGFASLNEMEEFAEAEDGGSSVPPSPYSTPSYLSVPLPAEPSPGARAPWEPTPSAPPARWGHGARRRCDLALLGCATLLGAVGLGADVAEARAADGEEQRRWLDGLFFPRAGRFPRGLSPPARPHGRREDVGPGLGLAPSATLVSLSSVSDCNSTRSLLRSDSDEAAPAAPSPPPSPPAPTPTPSPSTNPLVDLELESFKKDPRQSLTPTHVTAACAVSRGHRRTPSDGALGQRGPPEPAGHGPGPRDLLDFPRLPDPQALFPARRRPPEFPGRPTTLTFAPRPRPAASRPRLDPWKLVSFGRTLTISPPSRPDTPESPGPPSVQPTLLDMDMEGQNQDSTVPLCGAHGSH

SEQ ID NO: 743024 - protein, 222 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDGYRGVHCSL

SEQ ID NO: 743025 - protein, 954 aa, Homo sapiens; identical to SEQ ID NO: 743023

SEQ ID NO: 743026 - protein, 872 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDAPVPIIHRDLKSINILILEAIENHNLADTVLKITDFGLAREWHKTTKMSAAGTYAWMAPEVIRLSLFSKSSDVWSFGVLLWELLTGEVPYREIDALAVAYGVAMNKLTLPIPSTCPEPFARLLEECWDPDPHGRPDFGSILKRLEVIEQSALFQMPLESFHSLQEDWKLEIQHMFDDLRTKEKGFEHKITVQASPTLDKRKGSDGASPPASPSIIPRLRAIRLTPVDCGGSSSGSSSGGSGTWSRGGPPKKEELVGGKKKGRTWGPSSTLQKERVGGEERLKGLGEGSKQWSSSAPNLGKSPKHTPIAPGFASLNEMEEFAEAEDGGSSVPPSPYSTPSYLSVPLPAEPSPGARAPWEPTPSAPPARWGHGARRRCDLALLGCATLLGAVGLGADVAEARAADGEEQRRWLDGLFFPRAGRFPRGLSPPARPHGRREDVGPGLGLAPSATLVSLSSVSDCNSTRSLLRSDSDEAAPAAPSPPPSPPAPTPTPSPSTNPLVDLELESFKKDPRQSLTPTHVTAACAVSRGHRRTPSDGALGQRGPPEPAGHGPGPRDLLDFPRLPDPQALFPARRRPPEFPGRPTTLTFAPRPRPAASRPRLDPWKLVSFGRTLTISPPSRPDTPESPGPPSVQPTLLDMDMEGQNQDSTVPLCGAHGSH

SEQ ID NO: 743027 - protein, 512 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDAPVPIIHRDLKSINILILEAIENHNLADTVLKITDFGLAREWHKTTKMSAAGTYAWMAPEVIRLSLFSKSSDVWSFGVLLWELLTGEVPYREIDALAVAYGVAMNKLTLPIPSTCPEPFARLLEECWDPDPHGRPDFGSILKRLEVIEQSALFQMPLESFHSLQEDWKLEIQHMFDDLRTKEKELRSREEELLRAAQEQRFQEEQLRRREQELAEREMDIVERELHLLMCQLSQEKPRVRKRKGNFKRSRLLKLREGGSHISLPSGTHPCPQSAPQEAAGSSPDLGFISSFSFSTCFYC

SEQ ID NO: 743028 - protein, 878 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVARGMNYLHNDAPVPIIHRDLKSINILILEAIENHNLADTVLKITDFGLAREWHKTTKMSAAGTYAWMAPELRGAAVGAADGGGPYREIDALAVAYGVAMNKLTLPIPSTCPEPFARLLEECWDPDPHGRPDFGSILKRLEVIEQSALFQMPLESFHSLQEDWKLEIQHMFDDLRTKEKELRSREEELLRAAQEQRFQEEQLRRREQELAEREMDIVERELHLLMCQLSQEKPRVRKRKGNFKRSRLLKLREGGSHISLPSGFEHKITVQASPTLDKRKGSDGASPPASPSIIPRLRAIRLTPVDCGGSSSGSSSGGSGTWSRGGPPKKEELVGGKKKGRTWGPSSTLQKERVGGEERLKGLGEGSKQWSSSAPNLGKSPKHTPIAPGFASLNEMEEFAEAEDGGSSVPPSPYSTPSYLSVPLPAEPSPGARAPWEPTPSAPPARWGHGARRRCDLALLGCATLLGAVGLGADVAEARAADGEEQRRWLDGLFFPRAGRFPRGLSPPARPHGRREDVGPGLGLAPSATLVSLSSVSDCNSTRSLLRSDSDEAAPAAPSPPPSPPAPTPTPSPSTNPLVDLELESFKKDPRQSLTPTHVTAACAVSRGHRRTPSDGALGQRGPPEPAGHGPGPRDLLDFPRLPDPQALFPARRRPPEFPGRPTTLTFAPRPRPAASRPRLDPWKLVSFGRTLTISPPSRPDTPESPGPPSVQPTLLDMDMEGQNQDSTVPLCGAHGSH

SEQ ID NO: 743029 - protein, 423 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDAPVPIIHRDLKSINILILEAIENHNLADTVLKITDFGLAREWHKTTKMSAAGTYAWMAPEVIRLSLFSKSSDVWSFGVLLWELLTGEVPYREIDALAVAYGVAMNKLTLPIPSTCPEPFARLLEGEPGPRDEGRLSLEWQGPVGPPFPFTPIHTSGPRSEEEGAGTHWTLNSLPMVGSIPHIPALVWARASSQDNLLGFLGPWGFPPVDP

SEQ ID NO: 743030 - protein, 166 aa, Homo sapiens
VGLGLAVGGVIGGCPLAQVPVGPWPALQRSDGPLLVAEEFAEAEDGGSSVPPSPYSTPSYLSVPLPAEPSPGARAPWEPTPSAPPARWGHGARRRCDLALLGCATLLGAVGLGADVAEARAADGEEQRRWLDGLFFPRAGRFPRGLSPPARPHGRREDVGPGLGLA

SEQ ID NO: 743031 - protein, 85 aa, Homo sapiens
PHLCLVMEYARGGALSRVLAGRRVPPHVLVNWAVQVARGMNYLHNDAPVPIIHRDLKSINSKWCPLPKIPSTEPLKARPRWWETG

SEQ ID NO: 743032 - protein, 423 aa, Homo sapiens
RSSGLEQRSRLAATFPRQSARPGRARPPTAGSPGAAVAAAPPAAPAGAWAPAPLCRMGTVLSLSPASSAKGRRPGGLPEEKKKAPPAGDEALGGYGAPPVGKGGKGESRLKRPSVLISALTWKRLVAASAKKKKGSKKVTPKPASTGPDPLVQQRNRENLLRKGRDPPDGGGTAKPLAVPVPTVPAAAATCEPPSGGSAAAQPPGSGGGKPPPPPPPAPQVAPPVPGGSPRRVIVQASTGELLRCLGDFVCRRCYRLKELSPGELVGWFRGVDRSLLLQGWQDQAFITPANLVFVYLLCRESLRGDELASAAELQAAFLTCLYLAYSYMGNEISYPLKPFLVEPDKERFWQRCLRLIQRLSPQMLRLNADPHFFTQVFQDLKNEGEAAASGGGPPSGGAPAASSAARDSCAAGTKHWTMNLDR

SEQ ID NO: 743033 - protein, 423 aa, Homo sapiens; identical to SEQ ID NO: 743032

SEQ ID NO: 743034 - protein, 170 aa, Homo sapiens
RSSGLEQRSRLAATFPRQSARPGRARPPTAGSPGAAVAAAPPAAPAGAWAPAPLCRMGTVLSLSPASSAKGRRPGGLPEEKKKAPPAGDEALGGYGAPPVGKGGKGESRLKRPSVLISALTWKRLVAASAKKKKGSKKVTPKPASTGPDPLVQQRNRGVWICWAWSGDGR

SEQ ID NO: 743035 - protein, 148 aa, Homo sapiens
PLARQPPTSPTAPDYARQPPTSPTAPALSHSLMPVLPGPLLPLIHSPLSLSPSLSCSSLSSSLSLPFHFPFLGFVCLHLHLTPCLTVPRRPLFLLLHLCPHLPFLLLLSCVTIFPPVCLLPPLVSACIFLFLTESPHPSPLIKGNISF

SEQ ID NO: 743036 - protein, 106 aa, Homo sapiens
KDWAPARAALAHELGSKYLQRPWGNEGFFLSPPGKFGGDFLVYPGDPLRFHAHYIAQCWAPEDTIPLQDLVAAGRLGTSVRKTLLLCSPQPDGKVVYTSLQWASLQ

SEQ ID NO: 743037 - protein, 304 aa, Homo sapiens
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPGSIDTWPGRRSGSMIVITSILSSLAGLLLLAFLAASTMRFSSLWWPEEAPEQLRIGSFMGKRYMTHHIPPSEAATLPVGCKPGLDPLPSLSP

SEQ ID NO: 743038 - protein, 334 aa, Homo sapiens
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPLKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPSEAATLPVGCKPGLDPLPSLSP

SEQ ID NO: 743039 - protein, 334 aa, Homo sapiens; identical to SEQ ID NO: 743038

SEQ ID NO: 743040 - protein, 116 aa, Homo sapiens
TPSTCALLSLHYRLRSPALPRLEMDPNCSCATGKGRPGSVPWDAKFPDTIESVPGFEEVVFCYQRKRGLLYWSSAFLLAKLLRAFSSSLFLYVRVEGPEAQGCPAPRHLVGHRAAG

SEQ ID NO: 743041 - protein, 94 aa, Homo sapiens
YAVHVRLAVSPLSLEISSLTAACNGPQLLLRHWWLLHVRRLLQVQRVQMHLLQEELLLLLPSTNRVTRKIQDFLFFDYNLDPFATFLFFCEICE

SEQ ID NO: 743042 - protein, 104 aa, Homo sapiens
PSLKCLGKESFGESWESRILHPAEISHRNECHMKIILDFKSEKGPDAVAHTCNPSILGGHTAGGSLEARSFETNLPETLSLLKKLNLKEKEFVASYPPLVEMLK

SEQ ID NO: 743043 - protein, 277 aa, Homo sapiens
GGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLSSRVRTGRSIKGYTLPPHCSRGERRAVEKLSVEALNSLTGEFKGKYYPLKSMTEKEQQQSSMTTSCSTSRCPVLVAQAWPEWPKPWVWTMTTRAPGGGPGGTPGTPGTGTQGPRWRQKSKKAPGN

SEQ ID NO: 743044 - protein, 276 aa, Homo sapiens
GGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLTCPSNLGTGLRGGVHVKLAHLSKHPKFEEILTRLRLQKRGTGGVDTAAVGSVFDVSNADRWLVRSRTGAAGGGWCEAHGGNGEKLEKASIENGPRRIGLQLHVRDPRGGHQIVNAPHTGDLPYT

SEQ ID NO: 743045 - protein, 272 aa, Homo sapiens
GGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNQELKLMESSQHTRSFVLCPPRKATKIKASWPLTNQHTPQHPTAPHTHPHPPHTHCVRRRRPPQTTPPQHTLGRHPPSDSNNGPRSPRNPPNSRAPPQKSAAPQRRTPRRAPTAPRRHDHTRTAQQPHAHSTQAHTP

SEQ ID NO: 743046 - protein, 283 aa, Homo sapiens
GGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISEGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRWLVRSRTGAAGGGWCEAHGGNGEKLEKASIENGPRRIGLQLHVRDPRGGHQIVNAPHTGDLPYT

SEQ ID NO: 743047 - protein, 224 aa, Homo sapiens
MTEKEQQQSSMTTSCSTSRCPVLLAQAWPEWPKPWVWTMTTRAPGGVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRWLVRSRTGAAGGGWCEAHGGNGEKLEKASPSTNGPRRIGLQLHVRDPRGGHQIVNAPHTGDLPYT

SEQ ID NO: 743048 - protein, 267 aa, Homo sapiens
GGQCHLQDTDSPPSAQPSQVSYTATMPFGNTHNKFKGKYYPLKSMTEKEQQQSSMTTSCSTSRCPVLLAQAWPEWPKPWVWTMTTRAPGGVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRWLVRSRTGAAGGGWCEAHGGNGEKLEKASIENGPRRIGLQLHVRDPRGGHQIVNAPHTGDLPYT

SEQ ID NO: 743049 - protein, 215 aa, Homo sapiens
GGQCHLQDTDSPPSAQPSQVSYTATMPFGNTHNKFKLNYKPEEEYPDLSKHNNHMAKVLTLELCVGLQKIEEIFKKAGHPFMWNQHLGYVLTCPSNLGTGLRGGVHVKLAHLSKHPKFEEILTRLRLQKRGTGGVDTAAVGSVFDVSNADRWLVRSRTGAAGGGWCEAHGGNGEKLEKASIENGPRRIGLQLHVRDPRGGHQIVNAPHTGDLPYT

SEQ ID NO: 743050 - protein, 392 aa, Homo sapiens
GGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLNSLTGEFKGKYYPLKSMTEKEQQQSSMTTSCSTSRCPVLLAQAWPEWPKPWVWTMTTRAPGGVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRWLVRSRTGAAGGGWCEAHGGNGEKLEKASPSTNGPRRIGLQLHVRDPRGGHQIVNAPHTGDLPYT

SEQ ID NO: 743051 - protein, 239 aa, Homo sapiens
GGQCHLQDTDSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELLSSRVRTGRSIKGYTLPPHCSRGERRAVEKLSVEALNSLTGEFKGKYYPLKSMTEKEQQQSSMTTSCSTSRCPVLLAQAWPEWPKPWVWTMTTRAPGGGPGGTPGPRERGHRVRGGGKRAKKRRET

SEQ ID NO: 743052 - protein, 156 aa, Homo sapiens
MAGLPIPPEIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 743053 - protein, 229 aa, Homo sapiens
LGGRREGAGPGPGEQLRAPAAPRLLPAAAAPRLLPRCAAPGAGAESLPQLLGRPGQATPPSPVPLPDRTGRMEPPEGAGTGEIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 743054 - protein, 229 aa, Homo sapiens; identical to SEQ ID NO: 743053

SEQ ID NO: 743055 - protein, 195 aa, Homo sapiens
SGGLSLPSASQAPPVPLASPEGRPHTVGAPHASTWKRTRGRQRARPPKIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 743056 - protein, 231 aa, Homo sapiens [sequence omitted]

SEQ ID NO: 743057 - protein, 92 aa, Homo sapiens
SAKQAGTERGDGAPTPAEPPARLSRASLPAKAVRSTAGLRRLSSLTAALTRQPASSAARLLRAGEKRRRSAGDQEGDVKPEARGPPLRLCDL

SEQ ID NO: 743058 - protein, 92 aa, Homo sapiens; identical to SEQ ID NO: 743057

SEQ ID NO: 743059 - protein, 92 aa, Homo sapiens; identical to SEQ ID NO: 743057

SEQ ID NO: 743060 - protein, 983 aa, Homo sapiens
MNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGGPSRETGRREDITGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNSVYVNFLLTGLVAQLACHPQPLLRSFLLNTNMVFQPSVKSLLQVLGSVKNKIENFAASQEDFPALLSKAKKYLIARGKLDWAEGPAAGPAPRRSDPLVKSRRPSLGELLLRHAHSPTRARQAAQLVLQPGRDGAGLGLSGGSPGASTPVLLTRGGAPERQGEALRVKNAVYCAVIFPEFLKELAAISQAHAVTSPFLLETSEEGSGPLISGCGPLNP

SEQ ID NO: 743061 - protein, 969 aa, Homo sapiens
MNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNSVYVNFLLTGLVAQLACHPQPLLRSFLLNTNMVFQPSVKSLLQVLGSVKNKIENFAASQEDFPALLSKAKKYLIARGKLDWAEGPAAGPAPRRSDPLVKSRRPSLGELLLRHAHSPTRARQAAQLVLQPGRDGAGLGLSGGSPGASTPVLLTRGGAPERQGEALRVKNAVYCAVIFPEFLKELAAISQAHAVTSPFLLETSEEGSGPLISGCGPLNP

SEQ ID NO: 743062 - protein, 779 aa, Homo sapiens
MNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNPLFPAQHQHGLPAQCQVPAAGAGLCEE

SEQ ID NO: 743063 - protein, 779 aa, Homo sapiens; identical to SEQ ID NO: 743062

SEQ ID NO: 743064 - protein, 882 aa, Homo sapiens
MNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYQDHGLRGPKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNSVYVNFLLTGLVAQLACHPQPLLRSFLLNTNMVFQPSVKSLLQVLGSVKNKIENFAASQEDFPALLSKAKKYLIARGKLDWAEGPAAGPAPRRSDPLVKSRRPSLGELLLRHAHSPTRARQAAQLVLQPGRDGAGLGLSGGSPGASTPVLLTRGGAPERQGEALRVKNAVYCAVIFPEFLKELAAISQAHAVTSPFLLETSEEGSGPLISGCGPLNP

SEQ ID NO: 743065 - protein, 977 aa, Homo sapiens
MNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNSVYVNFLLTGLVAQLACHPQPLLRSFLLNTNMVFQPSVKSLLQVCDAMHAWVLGSVKNKIENFAASQEDFPALLSKAKKYLIARGKLDWAEGPAAGPAPRRSDPLVKSRRPSLGELLLRHAHSPTRARQAAQLVLQPGRDGAGLGLSGGSPGASTPVLLTRGGAPERQGEALRVKNAVYCAVIFPEFLKELAAISQAHAVTSPFLLETSEEGSGPLISGCGPLNP

SEQ ID NO: 743066 - protein, 231 aa, Homo sapiens [sequence omitted]

SEQ ID NO: 743067 - protein, 231 aa, Homo sapiens [sequence omitted]

SEQ ID NO: 743068 - protein, 969 aa, Homo sapiens; identical to SEQ ID NO: 743061

SEQ ID NO: 743069 - protein, 120 aa, Homo sapiens
GSLLLQCLSPVNLPRAVRYFLCFGQQCWEVLLGSRKVLNLILHRAQHLQQGLDTTPFCIPSEEPEAILGGVTPAACTQSNQGPAGGTIGPSAWARRSRTWPKWGLPWGFNSSSTHPGRGP

SEQ ID NO: 743070 - protein, 835 aa, Homo sapiens
MNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGKLLSLGLPFCVLFACSRHVCAGFLDLLAMSFLCTCLAPHPSCLHHFQIRVMSYLCPCVCLYVFHACAGLSIDLHLSLVCMSYVHVPPLSLVWPFPAICN

SEQ ID NO: 743071 - protein, 766 aa, Homo sapiens
MNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAALFANLRKVSQNRYVHLVFKASCPSK

SEQ ID NO: 743072 - protein, 98 aa, Homo sapiens
NACDVHCVQALYPCAHLPPNPGPFMAVLFAKLENMLQNSVYVNFLLTGLVAQLACHPQPLLRSFLLNTNMVFQPSVKSLLQVCDACMHGCVQAPWWAR

SEQ ID NO: 743073 - protein, 65 aa, Homo sapiens
VTPPFRPDIPSGLTCWIASSPDPPPYARPLMPPPRGPAPQILKTLLTLKNILKLSTNLSLVMMYI

SEQ ID NO: 743074 - protein, 233 aa, Homo sapiens
MKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPEQANSGPQMAGAQLSYPGGFPGGPGQMAGAPQPQKKLDPGSIPNPIQVIENE

SEQ ID NO: 743075 - protein, 145 aa, Homo sapiens
MKPAGPLGATATRGMLPPGPPPPGPHQFGQNGAHATGHPPQRFPGPPPVNNVASSHAPYQPSAQSSYPGPISTSSVTQLGSQLSAMQINSYDHGKSGSSDVVRQKREDRRGKSHSTEIYINRNAVYPVSHGKLHCNDSTVGHLSR

SEQ ID NO: 743076 - protein, 274 aa, Homo sapiens
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPEQANSGPQMAGAQLSYPGGFPGGPGQMAGAPQPQKKLDPGSIPNPIQVIENE

SEQ ID NO: 743077 - protein, 132 aa, Homo sapiens
MITEAVPEGQEHWSIRRLGTDNTQLGWDPSPPSPAVLTASRSRVENHFPPPILAQGCATSPKPRDHTGPRLFSGPPFWSRGPTELATSLPLLPRPQEPPTRGWMGGVTEHDSRCNDSYARGILSPPHPSLGP

SEQ ID NO: 743078 - protein, 119 aa, Homo sapiens
MCNPKLLLPSPSRGPFKRGWCFSLAPGTLPACRPRRKPRLRFVRGPGSIGGVVRASLGEDVVASVCWWRRWQASAGNPENTAEVECGDVCDTGDRATVDEEGYIWFLGRSHDTINASGW

SEQ ID NO: 743079 - protein, 106 aa, Homo sapiens
MDFNAYKWGDCASCEARAASAAWSERVSEKMWWLPFVGGGGGRPRRYVSQCPLGVSQSHQKRINLCHRSFSPFRGLAPPHLGHSLGFDPVRKRWEKSETTTINPQH

SEQ ID NO: 743080 - protein, 119 aa, Homo sapiens; identical to SEQ ID NO: 743078

SEQ ID NO: 743081 - protein, 119 aa, Homo sapiens; identical to SEQ ID NO: 743078

SEQ ID NO: 743082 - protein, 119 aa, Homo sapiens; identical to SEQ ID NO: 743078

SEQ ID NO: 743083 - protein, 119 aa, Homo sapiens; identical to SEQ ID NO: 743078

SEQ ID NO: 743084 - protein, 118 aa, Homo sapiens
MCNPKLLLPSPSRGPFKRGWCFSLAPGTLPACRPRRKPRLRFVRGPGSIGGVVRASLGEDVVASVCWWRRWQASAGNPENTAEVECGDVCDTGDRATVDEEGYIWFLGRSHDTINASG

SEQ ID NO: 743085 - protein, 119 aa, Homo sapiens; identical to SEQ ID NO: 743078

SEQ ID NO: 743086 - protein, 72 aa, Homo sapiens
MKSCGEDGFHIQVRLHPFHVMHINKTSCAGLTGSKQVYEVPLKSPRALWPGFTLVHDIVSIDTKLQHREHVI

SEQ ID NO: 743087 - protein, 590 aa, Homo sapiens [sequence omitted]

SEQ ID NO: 743088 - protein, 590 aa, Homo sapiens [sequence omitted]

SEQ ID NO: 743089 - protein, 590 aa, Homo sapiens [sequence omitted]

SEQ ID NO: 743090 - protein, 580 aa, Homo sapiens
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLTQNKKSDVYGNDSLEICLPYPIEHPYHTHICRGTMFPTFTSPEDLYTGIKARTQQPFPPTVPSKAYDSTVLKTRGNPYRYELIDIPMDSKKKALTWPGQGVYYDFPRGVEKNKPVFYPKPPKTFAPNTSLNSWDPICSAKEANIQRNLERSHWLTSYTHDFTGLGPMDPLELDDYHEKMVAELTRKIGFDPEPQEKFHPVFKPPRPLEGRIARLIQNRRSLEAIVQQRPRSCPDCTPRVLCNFHTFVPSSKEMVALSDNIPAGVTHKNQDIEEKIIEEQSLLSTYELPSCYPTKDLTSIYDIKPFPKITDTKKTEDLYWRQQSLKTQPTPYCKPDHWIHYENLKSPLRDQYNMCPDPVSLSKPSVLQNKQDTEAFTLEHFLSKPEEELFLNMENNEETRPVLGWIPRAGVTKPQTNLLELKNSFSKTGAQKRFHKSILEDHKDLRDNEHSGMKHQFYGHNSYYFYN

SEQ ID NO: 743091 - protein, 140 aa, Homo sapiens
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLTQNKKSDVYGNDSLIPKPPNSTVGLQ

SEQ ID NO: 743092 - protein, 232 aa, Homo sapiens
VNRIVYRTGGDIIWMSLGLNAAQSILDDGCEMSCASLHQKQMGYESGAGMIEIHSGWGDRSPDVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMVSSIRSVVTGMLGY

SEQ ID NO: 743093 - protein, 671 aa, Homo sapiens
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMSTIGSMMSIYSEAGDFGNIFVTGRIAFSLKYEQQTQSLVVHVKECHQLAYADEAKKRSNPYVKTYLLPDKSRQGKRKTSIKRDTVNPLYDETLRYEIPESLLAQRTLQFSVWHHGRFGRNTFLGEAEIQMDSWKLDKKLDHCLPLHGKISAESPTGLPSHKGELVVSLKYIPASKTPVGGDRKKSKGGEGGELQVWIKEAKNLTAAKAGGTSDSFVKGYLLPMRNKASKRKTPVMKKTLNPHYNHTFVYNGVRLEDLQHMCLELTVWDREPLASNDFLGGVRLGVGTGISNGEVVDWMDSTGEEVSLWQKMRQYPGSWAEGTLQLRSSMAKQKLGL

SEQ ID NO: 743094 - protein, 671 aa, Homo sapiens; identical to SEQ ID NO: 743093

SEQ ID NO: 743095 - protein, 644 aa, Homo sapiens
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMSTIGSMMSIYSEAGDFGNIFVTGRIAFSLKYEQQTQSLVVHVKECHQLAYADEAKKRSNPYVKTYLLPDKSRQGKRKTSIKRDTVNPLYDETLRYEIPESLLAQRTLQFSVWHHGRFGRNTFLGEAEIQMDSWKLDKKLDHCLPLHGKISAESPTGLPSHKGELVVSLKYIPASKTPVGGDRKKSKGGEGGELQVWIKEAKNLTAAKAGGTSDSFVKGYLLPMRNKASKRKTPVMKKTLNPHYNHTFVYNGVRLEDLQHMCLELTVWDREPLASNDFLGGVRLGVGTGEIPSPTILQDTVWTVGSSRVC

SEQ ID NO: 743096 - protein, 280 aa, Homo sapiens
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSGNWFPLLVFQD

SEQ ID NO: 743097 - protein, 671 aa, Homo sapiens; identical to SEQ ID NO: 743093

SEQ ID NO: 743098 - protein, 349 aa, Homo sapiens
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMVSSIRSVVTGMLGY

SEQ ID NO: 743099 - protein, 326 aa, Homo sapiens
ARSRKCCGRRRRASRRHVWSPGSRSVAGPWPLPDISTMSFVAYEELIKEGDTAILSLGHGAMVAVRVQRGAQTQTRHGVLRHSVDLIGRPFGSKVTCGRGGWVYVLHPTPELWTLNLPHRTQILYSTDIALITMMLELRPGSVVCESGTGSGSVSHAIIRTIAPTGHLHTVEFHQQRAEKAREEFQEHRVGRWVTVRTQDVCRSGFGVSHVADAVFLDIPSPWEAVGHAWDALKVEGGRFCSFSPCIEQVQRTCQALAARGFSELSTLEVLPQVYNVRTVSLPPPDLGTGTDGPAGSDTSPFRSGTPMKEAVGHTGYLTFATKTPG

SEQ ID NO: 743100 - protein, 326 aa, Homo sapiens; identical to SEQ ID NO: 743099

SEQ ID NO: 743101 - protein, 326 aa, Homo sapiens; identical to SEQ ID NO: 743099

SEQ ID NO: 743102 - protein, 326 aa, Homo sapiens; identical to SEQ ID NO: 743099

SEQ ID NO: 743103 - protein, 326 aa, Homo sapiens; identical to SEQ ID NO: 743099

SEQ ID NO: 743104 - protein, 206 aa, Homo sapiens
ARSRKCCGRRRRASRRHVWSPGSRSVAGTGSGSVSHAIIRTIAPTGHLHTVEFHQQRAEKAREEFQEHRVGRWVTVRTQDVCRSGFGVSHVADAVFLDIPSPWEAVGHAWDALKVEGGRFCSFSPCIEQVQRTCQALAARGFSELSTLEVLPQVYNVRTVSLPPPDLGTGTDGPAGSDTSPFRSGTPMKEAVGHTGYLTFATKTPG

SEQ ID NO: 743105 - protein, 111 aa, Homo sapiens
MIGAPVSRTKGQMCGHPHLAAEKATPSWGWGGPGVLGLLPQSWAGIQCGCLGYLYAPLKEGSTPGRLVPAKCHTVGHRGLWLMWSGRPVSLRVAQPCSEGLSSPSRTQLPF

SEQ ID NO: 743106 - protein, 80 aa, Homo sapiens
PASGQGWVSSPQLLAKAGASARGLEKHEMVSGPVGQPGRGGPGVRSWGELTQNPCPALPSARRPGQPRNQGGDPALWPPG

SEQ ID NO: 743107 - protein, 101 aa, Homo sapiens
MSFVAYEELIKEGDTAILSLGHGAMVAVRVQRGAQTQTRHGVLRHSVDLIGRPFGSKVTCGRGGWVYVLHPTPELWTLNLPHRTQILYSTDIALITMMLEL

SEQ ID NO: 743108 - protein, 1724 aa, Homo sapiens
MTANRDGRDYFINHMTQAIPFDDPRLESCQIIPPAPRKVEMRRDPVLGFGFVAGSEKPVVVRSVTPGGPSEGKLIPGDQIVMINDEPVSAAPRERVIDLVRSCKESILLTVIQPYPSPKSAFISAAKKARLKSNPVKVRFSEEVIINGQVSETVKDNSLLFMPNVLKVYLENGQTKSFRFDCSTSIKDVILTLQEKLSIKGIEHFSLMLEQRTEGAGTKLLLLHEQETLTQVTQRPSSHKMRCLFRISFVPKDPIDLLRRDPVAFEYLYVQSCNDVVQERFGPELKYDIALRLAALQMYIATVTTKQTQKISLKYIEKEWGLETFLPSAVLQSMKEKNIKKALSHLVKANQNLVPPGKKLSALQAKVHYLKFLSDLRLYGGRVFKATLVQAEKRSEVTLLVGPRYGISHVINTKTNLVALLADFSHVNRIEMFSEEESLVRVELHVLDVKPITLLMESSDAMNLACLTAGYYRLLVDSRRSIFNMANKKNTATQETGPENKGKHNLLGPDWNCIPQMTTFIGEGEQEAQITYIDSKQKTVEITDSTMCPKEHRHLYIDNAYSSDGLNQQLSQPGEAPCEADYRSLAQRSLLTLSGPETLKKAQESPRGAKVSFIFGDFALDDGISPPTLGYETLLDEGPEMLEKQRNLYIGSANDMKGLDLTPEAEGIQFVENSVYANIGDVKSFQAAEGIEEPLLHDICYAENTDDAEDEDEVSCEEDLVVGEMNQPAILNLSGSSDDIIDLTSLPPPEGDDNEDDFLLRSLNMAIAAPPPGFRDSSDEEDSQSQAASFPEDKEKGSSLQNDEIPVSLIDAVPTSAEGKCEKGLDNAVVSTLGALEALSVSEEQQTSDNSGVAILRAYSPESSSDSGNETNSSEMTESSELATAQKQSENLSRMFLATHEGYHPLAEEQTEFPASKTPAGGLPPKSSHALAARPATDLPPKVVPSKQLLHSDHMEMEPETMETKSVTDYFSKLHMGSVAYSCTSKRKSKLADGEGKAPPNGNTTGKKQQGTKTAEMEEEASGKFGTVSSRDSQHLSTFNLERTAFRKDSQRWYVATEGGMAEKSGLEAATGKTFPRASGLGAREAEGKEEGAPDGETSDGSGLGQGDRFLTDVTCASSAKDLDNPEDADSSTCDHPSKLPEADESVARLCDYHLAKRMSSLQSEGHFSLQSSQGSSVDAGCGTGSSGSACATPVESPLCPSLGKHLIPDASGKGVNYIPSEERAPGLPNHGATFKELHPQTEGMCPRMTVPALHTAINTEPLFGTLRDGCHRLPKIKETISVALTEPGKERRGGMPSAWSQHPEADPILLPSNIHSESKVPIPNQDPNDFSQANQAYGEAVSWRPPDLRGGSLRTPPSQKALRHSSSILSGSVDLETFRERTKGAVSLKCPGITEAQEASSERRAELPLGRKLTKSFSQSSMHLSSEGRFHKRSPVAHKDSKLYRTLPLRKLEGSNWRCRGPFSYCFLNRGQDEDGEEEEERGEATVQVSCLYRPQVTQAMPEPSSPCLAVAIQKQRGELSRGSVLKVWAEDLRDPDDLDFSNLAFDARIARINALKESTYAMPDGFLAAQNDANELLCLVRATKEKREESRPEAYDLTLSQYKQLLSIESRQLGSACRKMAMAEKSPEEMLLAMTSSFQVLCCLTEACMRLVKVVNSETQRQEIVGKIDEVVINYICLLKAAEAATGKNPGDPNVGLSARHSTTMAALVSTLTRSLKRLLNK

SEQ ID NO: 743109 - protein, 342 aa, Homo sapiens
PCSWTGVGCTLKMPRSFLVKSKKAHTYHQPRVQEDEPLWPPALTPVPRDQAPSNSPVLSTLFPNQCLDWTNLKREPELEQDQNLARMAPAPEGPIVLSRPQDGDSPLSDSPPFYKPSFSWDTLATTYGHSYRQAPSTMQSAFLEHSVSLYGSPLVPSTEPALDFSLRYSPGMDAYHCVKCNKVFSTPHGLEVHVRRSHSGTRPFACDICGKTFGHAVSLEQHTHVHCPGAHFECRMCGKAFKRSSTLSTHLLIHSDTRPYPCQFCGKRFHQKSDMKKHTYIHTGEKPHKCQVCGKAFSQSSNLITHSRKHTGFKPFSCELCTKGFQRKVDLRRHRESQHNLK

SEQ ID NO: 743110 - protein, 130 aa, Homo sapiens
LRKSRFCLESSFLCPVPDSETGYWQFGLPWTLPHPWAMLAWHGEMKALGLPESCPCLCQDRRSEITRSCFYASSEWAHSMPFQATTFLLAVVVGHWVEAPLDLYLVDENNNPCLAGWMCCFTGDYLIHVT

SEQ ID NO: 743111 - protein, 213 aa, Homo sapiens
ENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRTVLELGSGAGLTGLAICKMCRPRAYIFSDPHSRILEQLRGNVLLNGLSLEADITGNLDSPRVTVAQLDWDVAMVHQLSAFQPDVVIAAGNAQ

SEQ ID NO: 743112 - protein, 237 aa, Homo sapiens
ENAGTELLLQGFERRFLAVRTLRSFPWQSLEAKLRDSSDSELLRDILQKTVRHPVCVKHPPSVKYAWCFLSELIKKHEAVHTEPLDKLYEVLAETLMAKESTQATGAICCPQEARSHSPRAQPSSPTVPQAWSHGMPPSTLQNGPSRTRQPSLTDVLYCPEAIVSLVGVLQRLAACREHKRAPEVYVAFTVRNPETCQLFTTELGRDGIRWEAEAHHDQKLFPYGEHLEMAMLNLTL

SEQ ID NO: 743113 - protein, 237 aa, Homo sapiens; identical to SEQ ID NO: 743112

SEQ ID NO: 743114 - protein, 203 aa, Homo sapiens
ENAGTELLLQGFERRFLAVRTLRSFPWQSLEAKLRDSSDSELLRDILQKTVRHPVCVKHPPSVKYAWCFLSELIKKSSGGSSHSPRAQPSSPTVPQAWSHGMPPSTLQNGPSRTRQPSLTDVLYCPEAIVSLVGVLQRLAACREHKRAPEVYVAFTVRNPETCQLFTTELGRDGIRWEAEAHHDQKLFPYGEHLEMAMLNLTL

SEQ ID NO: 743115 - protein, 264 aa, Homo sapiens
ENAGTELLLQGFERRFLAVRTLRSFPWQSLEAKLRDSSDSELLRDILQKTVRHPVCVKHPPSVKYAWCFLSELIKKHEAVHTEPLDKLYEVLAETLMAKESTQATGAICCPQEARSHSPRAQPSSPTVPQAWSHGMPPSTLQNGPSRTRQPSLTDVLYCPEAIVSLVGVLQRLAACREHKRAPEVYVAFTVRNPETCQLFTTELGEPPRPPGPTWCPSCPCRTPVEVKELGAGEKLGCSTLPHYAGNSGRGRPGWDQMGSGSSS

SEQ ID NO: 743116 - protein, 87 aa, Homo sapiens
DLPDLIDAFAVPGDAYTDYVATRWYRAPELLVGDTQYGSSVDIWAIGCVFAELLTGQPLWPGKSDVDQLYLIIRTLGMNCILWQQSC

SEQ ID NO: 743117 - protein, 110 aa, Homo sapiens
LDFVARIEDFLYLQVLALVYQKNQSHMVLENECKVLLSAGSSLLLFHQYALHNQPLVCSSTDVSSQCPDASVSALLGSWAFIDLGWGGGEPGWSWEMQHLGVKSGVPVLT

SEQ ID NO: 743118 - protein, 108 aa, Homo sapiens
EEPTCPPGRDGPFHLRFQEIAQGEGVEGGVLRRNMKPPVVSSTSKTTKKRQLGWSVRRSCHPSWGWQSNRDRHHITMGREENKRKMKIIFHQKTGKRRLWWEGLCWWE

SEQ ID NO: 743119 - protein, 322 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 743120 - protein, 322 aa, Homo sapiens; identical to SEQ ID NO: 743119

SEQ ID NO: 743121 - protein, 322 aa, Homo sapiens; identical to SEQ ID NO: 743119

SEQ ID NO: 743122 - protein, 309 aa, Homo sapiens
SRAVLEDPLESATGSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 743123 - protein, 253 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKREMLLSDDCYTSARGCTATLGNFAKATFDAISKTYSYLTPDLWKETVFTKSPYQEFTDHLVKTHTRVSVQRTQAPAVATT

SEQ ID NO: 743124 - protein, 116 aa, Homo sapiens
AAGSYSTSVGGPNRIVSSSRPLVSCSRGLHPSIGSLRLPMSQKRKLGWRKFRSPRTRGWKWQNPGFRGWASGVLQGPQHGSEGLGLNPPSPWTLVPSKPRARALSVASPRDALQGR

SEQ ID NO: 743125 - protein, 469 aa, Homo sapiens
AESDASEPRRIVGGGCLQFLLPLPAKMSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 743126 - protein, 477 aa, Homo sapiens
AESDASEPRRIVGGGCLQFLLPLPAKMSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQNSDFLCQMMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 743127 - protein, 469 aa, Homo sapiens; identical to SEQ ID NO: 743125

SEQ ID NO: 743128 - protein, 469 aa, Homo sapiens; identical to SEQ ID NO: 743125

SEQ ID NO: 743129 - protein, 469 aa, Homo sapiens; identical to SEQ ID NO: 743125

SEQ ID NO: 743130 - protein, 319 aa, Homo sapiens
MDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 743131 - protein, 449 aa, Homo sapiens
SSDPHHLSDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQNSDFLCQMMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 743132 - protein, 134 aa, Homo sapiens
MTNFRYCAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 743133 - protein, 469 aa, Homo sapiens; identical to SEQ ID NO: 743125

SEQ ID NO: 743134 - protein, 469 aa, Homo sapiens; identical to SEQ ID NO: 743125

SEQ ID NO: 743135 - protein, 176 aa, Homo sapiens
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSCMNIIWTLPYACFHIIEFNLES

SEQ ID NO: 743136 - protein, 739 aa, Homo sapiens
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALYDYMGSEMMAVTQKIVQVIGLVNTMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 743137 - protein, 216 aa, Homo sapiens
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQGPFKW

SEQ ID NO: 743138 - protein, 106 aa, Homo sapiens
MGKAAAAVAFGAEVGVRLALFAAFLVTELLPPFQRLIQPEEMWLYRNPYVEAEYFPTKPMFVRGERSSFLPPHDPASRGHLCVFHPETAFVGTHCPLRCCALGSAS

SEQ ID NO: 743139 - protein, 264 aa, Homo sapiens [sequence omitted]

SEQ ID NO: 743140 - protein, 132 aa, Homo sapiens
MCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVLSTAQKPGDSYCFDI

SEQ ID NO: 743141 - protein, 246 aa, Homo sapiens
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIGLAHSDLMCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVLSTAQKPGDSYCFDI

SEQ ID NO: 743142 - protein, 223 aa, Homo sapiens
MWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVLSTAQKPGDSYCFDI

SEQ ID NO: 743143 - protein, 121 aa, Homo sapiens
DGEGGGGGGLWGRSGRAARAVRGLPVRKIHGRARAAPLPRVTELLPPFQRLIQPEEMWLYRNPYVEAEYFPTKPMFVRGERSSFLPPHDPASRGHLCVFHPETAFVGTHCPLRCCALGSAS

SEQ ID NO: 743144 - protein, 90 aa, Homo sapiens
MGKAAAAVAFGAEVGVRLALFAAFLVTELLPPFQRLIQPEEMWLYRNPYVEAEYFPTKPMFVRGERSSFLPPHDPASRGHLLLHFSLHCL

SEQ ID NO: 743145 - protein, 181 aa, Homo sapiens
MTRLPAGTSASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVLSTAQKPGDSYCFDI

SEQ ID NO: 743146 - protein, 132 aa, Homo sapiens; identical to SEQ ID NO: 743140

SEQ ID NO: 743147 - protein, 163 aa, Homo sapiens [sequence omitted]

SEQ ID NO: 743148 - protein, 106 aa, Homo sapiens; identical to SEQ ID NO: 743138

SEQ ID NO: 743149 - protein, 106 aa, Homo sapiens; identical to SEQ ID NO: 743138

SEQ ID NO: 743150 - protein, 320 aa, Homo sapiens
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVTFHCTEAWGFFMLIFNQLNLAGRGGLMPVITALGEGEQAGLNLLTSGSICLVLPKCWDYRRESPCPARSNS

SEQ ID NO: 743151 - protein, 282 aa, Homo sapiens
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVLSTAQKPGDSYYSHAHKNAFTGQARWLTPVILA

SEQ ID NO: 743152 - protein, 106 aa, Homo sapiens; identical to SEQ ID NO: 743138

SEQ ID NO: 743153 - protein, 175 aa, Homo sapiens
MKIDSFLPILRMWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTCEWTGDLIFFGGTLLKDSYFVENGLFLSKIGYYLLFFFSCFGRIF

SEQ ID NO: 743154 - protein, 421 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVLFIDNWRVLHGRECFTGYRQLCGCYLTRDDVLNTARLLGLQA

SEQ ID NO: 743155 - protein, 376 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRLFKEKQNTVNRQWNSSLQCDIPERILTYRHFVSGTSIEHRGSLI

SEQ ID NO: 743156 - protein, 383 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVGPNL

SEQ ID NO: 743157 - protein, 419 aa, Homo sapiens
GAGPTGSPLGPSGLGEGSVGPTVLGVKRQKAGERLPPETLLAWNSAHSAELAVTTSSTELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVLFIDNWRVLHGRECFTGYRQLCGCYLTRDDVLNTARLLGLQA

SEQ ID NO: 743158 - protein, 432 aa, Homo sapiens
MKIDSFLPILRMWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVLFIDNWRVLHGRECFTGYRQLCGCYLTRDDVLNTARLLGLQA

SEQ ID NO: 743159 - protein, 421 aa, Homo sapiens; identical to SEQ ID NO: 743154

SEQ ID NO: 743160 - protein, 372 aa, Homo sapiens
EVTLEDPEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVLFIDNWRVLHGRECFTGYRQLCGCYLTRDDVLNTARLLGLQA

SEQ ID NO: 743161 - protein, 383 aa, Homo sapiens; identical to SEQ ID NO: 743156

SEQ ID NO: 743162 - protein, 253 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCG

SEQ ID NO: 743163 - protein, 113 aa, Homo sapiens
AERKATPALPQGCRHDLCQLRDRVCPEISVRPDGPSAQEELEELEQARVGTDAQCTLFQSRSDFTALDLSLTWCLAFSESLPSSCLTLFGSRVEGGTQLSARSCSTFFRSHIH

SEQ ID NO: 743164 - protein, 277 aa, Homo sapiens
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVVQAPSFLLFI

SEQ ID NO: 743165 - protein, 277 aa, Homo sapiens; identical to SEQ ID NO: 743164

SEQ ID NO: 743166 - protein, 277 aa, Homo sapiens
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVVQAPSFLFFI

SEQ ID NO: 743167 - protein, 277 aa, Homo sapiens; identical to SEQ ID NO: 743164

SEQ ID NO: 743168 - protein, 277 aa, Homo sapiens; identical to SEQ ID NO: 743164

SEQ ID NO: 743169 - protein, 277 aa, Homo sapiens; identical to SEQ ID NO: 743166

SEQ ID NO: 743170 - protein, 67 aa, Homo sapiens
TNHMTHHLPIFLTGHSRALCGQLIFHGAQNIIDSRENGRSLHIVVGKVGQWGLSRLISFLLYKVENF

SEQ ID NO: 743171 - protein, 279 aa, Homo sapiens
ARGQRVAFPVGARPGRRRWRSSRRSLVMSGRRTRSGGAAQRSGPRAPSPTKPLRRSQRKSGSELPSILPEIWPKTPSAAAVRKPIVLKRIVAHAVEVPAVQSPRRSPRISFFLEKENEPPGRELTKEDLFKTHSVPATPTSTPVPNPEAESSSKEGELDARDLEMSKKVRRSYSRLETLGSASTSTPGRRSCFGFEGLLGAEDLSGVSPVVCSKLTEVPRVCAKPWAPDMTLPGISPPPEKQKRKKKKMPEILKTELDEWAAAMNAEFEAAEQFDLLVE

SEQ ID NO: 743172 - protein, 262 aa, Homo sapiens
ARGQRVAFPVGARPGRRRWRSSRRSLVMSGRRTRSGGAAQRSGPRAPSPTKPLRRSQRKSGSELPSILPEIWPKTPSAAAVRKPIVLKRIVAHAVEVPAVQSPRRSPRISFFLEKENEPPGRELTKEDLFKTHSVPATPTSTPVPNPEAESSSKEGELDARDLEMSKKVRRSYSRLETLGSASTSTPGRRSCFGFEGLLGAEDLSGVSPVVCSKLTEVPRVCAKPWAPDMTLPPELPSVGGFLLEPTCVKRFSVPWVSPLIL

SEQ ID NO: 743173 - protein, 105 aa, Homo sapiens [sequence omitted]

SEQ ID NO: 743174 - protein, 201 aa, Homo sapiens
MHSGREKPSNWEPFRKVVSGRIIKGYCRGDWLLSFVYRTSSVQLRVAGLQPVLLQDRRVENVDLTSVVSGHLDYAKQMDAILKAVGIRTKPGWDEKGLLLAPGCLPSEEPRQAAAAASSGETPHQVGQTQGPISGDTSKLAMSTDPSQAQVPVGLDQSEGASLPAAASPERPPICSHGMDPNPLGCPDCACKTQGPSTGLD

SEQ ID NO: 743175 - protein, 50 aa, Homo sapiens
MLNCIQYGCELGLGTRMNFTWKEFPVAGTEGITTAINNNKKKLPLLEHVP

SEQ ID NO: 743176 - protein, 124 aa, Homo sapiens
GPRSVAQDGVQWCNHGSLQPQPPGLKQSSHLSLLSSWDYRHVLGKRLMGCLHRLAIKIWDNKLWKATKGLSEGKPPNCHHVALLRARHTLLFVNTVQGERHSFETLEGEQMCRLLVKPLPLATL

SEQ ID NO: 743177 - protein, 87 aa, Homo sapiens
YFLFQNEEVKFIENELEIQKQKYFKLQTFVRSLILAMKADDKEQQQALLSDLPPELEEMDFNHASLEPDDTSFSVSSLSEKNVSESL

SEQ ID NO: 743178 - protein, 84 aa, Homo sapiens
DSFFPTAIPAFPHLSSSWPVGPGFWGLLGVACDRNNAEASAESPSLVEAQQTSRKSGFIISVENGPSKLWSYEVLSSLPLQHFP

SEQ ID NO: 743179 - protein, 83 aa, Homo sapiens
APAASSAGPLGVNSVGALKRKNFRFVDSNHHLQRSSHCWRDRGLGDKSSRLPESFCCKAQGPPPTSRRDQEGTIAKPRGCRGL

SEQ ID NO: 743180 - protein, 314 aa, Homo sapiens
MGCRCCKIIQSYLFDPVQVPSPGYVNEVNSCKLDEDDTDKLKGKWSSEVLVQKNDPQRQGSKKTESSSRTADPWEPCWPHQGPLPQGDAGGEHHACGVNGIGPAATPQPTGNSSPTQDDRGSWASTANTVPPTQPFLEGGGTRKQDCVLLASEGTQVMRNGDSRAPSEAESFALEVQDHVFQIPAPDYLQHWGPAGDNVDHNEKDCVFKNHTEDESLEGIQPPVGEHGLNTPFSVRRSWDSLNEDVETEVLSICFNEKGPVHAMPVVDSGNRQEDTHGSDGDGDGEIVDEDAAVAEALAALEAATAGEDLDETD

SEQ ID NO: 743181 - protein, 314 aa, Homo sapiens; identical to SEQ ID NO: 743180

SEQ ID NO: 743182 - protein, 314 aa, Homo sapiens; identical to SEQ ID NO: 743180

SEQ ID NO: 743183 - protein, 312 aa, Homo sapiens
MGCRCCKIIQSYLFDPVQVPSPGYVNEVNSCKLDEDDTDKLKGKWSSEVLVQKNDPQRQGSKKTESSSRTADPWEPCWPHQGPLPQGDAGGEHHACGVNGIGPAATPQPTGNSSPTQDDRGSWASTANTVPPTQPFLEGGGTRKQDCVLLASEGTQVMRNGDSRAPSEAESFALEVQDHVFQIPAPDYLQHWGPAGDNVDHNEKDCVFKNHTEDESLEGIQPPVGEHGLNTPFSVRRSWDSLNEDVETEVLSICFNEKGPVHAMPVVDSGPRRRRRRRRLAPGREVKLLEKPNRQYPQQVVTENNPDGVQVL

SEQ ID NO: 743184 - protein, 212 aa, Homo sapiens
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEEIEWLKFLALACSALGVTITKTLKIVCEVLSCDHNGGSPRIPFSTFQFLYTYIAKVDGEISASHVSRMLNYMEQEVIGPDGIITVNDFTQNPRVQLE

SEQ ID NO: 743185 - protein, 120 aa, Homo sapiens
MWKVVNLPTDLFNSVMNVGRFTEEIEWLKFLALACSALGVTITKTLKIVCEVLSCDHNGGSPRIPFSTFQFLYTYIAKVDGEISASHVSRMLNYMEQEVIGPDGIITVNDFTQNPRVQLE

SEQ ID NO: 743186 - protein, 212 aa, Homo sapiens; identical to SEQ ID NO: 743184

SEQ ID NO: 743187 - protein, 212 aa, Homo sapiens; identical to SEQ ID NO: 743184

SEQ ID NO: 743188 - protein, 219 aa, Homo sapiens
MCPANQSMAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEEIEWLKFLALACSALGVTITKTLKIVCEVLSCDHNGGSPRIPFSTFQFLYTYIAKVDGEISASHVSRMLNYMEQEVIGPDGIITVNDFTQNPRVQLE

SEQ ID NO: 743189 - protein, 390 aa, Homo sapiens
CSGYLESSARRWESRAEPGLSSGSRRPGQRRPGGARAPHRTIRLGVERSRSPTRSPGPTRHRRFLSTHGDQETLKEFGVSGAGKSRIPAPGPRLATSLMGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQPAPEPPAPAPHWAVYVGGGQIIHLHQGEIRQDSLYEAGAANVGRVVNSWYRYRPLVAELVVQNACGHLGLKSEEICWTNSESFAAWCRFGKREFKAGGEVPAGTQPPQQQYYLKVHLGENKVHTARFHSLEDLIREKRRIDASGRLRVLQELADLVDDKE

SEQ ID NO: 743190 - protein, 471 aa, Homo sapiens
CSGYLESSARRWESRAEPGLSSGSRRPGQRRPGGARAPHRTIRLGVERSRSPTRSPGPTRHRRFLSTHGDQETLKEFGVSGAGKSRPTPRSFLGVRLPHCHSQHSPPHRDPASSPASLGVFFWELDRVPGRGRRLCGGVCSRLTCGGFSAPRTPGEARRTRLERVTPIPAPGPRLATSLMGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQPAPEPPAPAPHWAVYVGGGQIIHLHQGEIRQDSLYEAGAANVGRVVNSWYRYRPLVAELVVQNACGHLGLKSEEICWTNSESFAAWCRFGKREFKAGGEVPAGTQPPQQQYYLKVHLGENKVHTARFHSLEDLIREKRRIDASGRLRVLQELADLVDDKE

SEQ ID NO: 743191 - protein, 168 aa, Homo sapiens [sequence omitted]

SEQ ID NO: 743192 - protein, 390 aa, Homo sapiens; identical to SEQ ID NO: 743189

SEQ ID NO: 743193 - protein, 68 aa, Homo sapiens
MGNQLDRITHLNYSELPTGDPSGIEKDELRVGVAYFFSDDEEDLDERGQPDKFGVKAPPGCTPCPESP

SEQ ID NO: 743194 - protein, 390 aa, Homo sapiens
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 743195 - protein, 388 aa, Homo sapiens
MQYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 743196 - protein, 246 aa, Homo sapiens
MIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 743197 - protein, 141 aa, Homo sapiens [sequence omitted]

SEQ ID NO: 743198 - protein, 390 aa, Homo sapiens; identical to SEQ ID NO: 743194

SEQ ID NO: 743199 - protein, 390 aa, Homo sapiens; identical to SEQ ID NO: 743194

SEQ ID NO: 743200 - protein, 390 aa, Homo sapiens; identical to SEQ ID NO: 743194

SEQ ID NO: 743201 - protein, 448 aa, Homo sapiens
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYQWVFKTLNPFNPIPPKARGEGCKVIARGMPGVGPIGVLKLLGNSPFIPNPPKLPPPSWL

SEQ ID NO: 743202 - protein, 390 aa, Homo sapiens; identical to SEQ ID NO: 743194

SEQ ID NO: 743203 - protein, 68 aa, Homo sapiens
GMDGDPSVQSTLAMLALRPGTGEHEQDDISSVCLGHLLADEKSSLTACSPPAFRLHPWNVTFCLLENV

SEQ ID NO: 743204 - protein, 636 aa, Homo sapiens [sequence omitted]

SEQ ID NO: 743205 - protein, 200 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVRWGWLSPAEGCALFPRGALLRSPQGLDGLDQDFPEGEG

SEQ ID NO: 743206 - protein, 468 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 743207 - protein, 468 aa, Homo sapiens; identical to SEQ ID NO: 743206

SEQ ID NO: 743208 - protein, 468 aa, Homo sapiens; identical to SEQ ID NO: 743206

SEQ ID NO: 743209 - protein, 577 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSRLEYSGSISDHCNLCLPGSSDSPASASRVAGITGFHHVAQAHLELVGSRNSPAFSLPTCWDYSRWSCHEQPYGEDHVVRNSANSHVTELGRGSCCPGQHLTAILSVEFPG

SEQ ID NO: 743210 - protein, 523 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSRLEYSGSISDHCNLCLPGSSDSPASASRVAGITGFHHVAQAHLELVGSRNSPAFSQ

SEQ ID NO: 743211 - protein, 421 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQDAVSLCFPGWSAMT

SEQ ID NO: 743212 - protein, 417 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLVLIRKCMHAGGGERERVRMD

SEQ ID NO: 743213 - protein, 183 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVVRNSANSHVTELGRGSCCPGQHLTAILSVEFPG

SEQ ID NO: 743214 - protein, 482 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTLSSAGFSAWIKDSTAEQNRSKTTVLARRSGSHLKSQHFGRPKWADHEVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQGWSTVARFQITATSAFQVQAILLPQPPE

SEQ ID NO: 743215 - protein, 468 aa, Homo sapiens; identical to SEQ ID NO: 743206

SEQ ID NO: 743216 - protein, 468 aa, Homo sapiens; identical to SEQ ID NO: 743206

SEQ ID NO: 743217 - protein, 468 aa, Homo sapiens; identical to SEQ ID NO: 743206

SEQ ID NO: 743218 - protein, 432 aa, Homo sapiens
FLSSHLGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 743219 - protein, 515 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTLSSAGFSAWIKDSTAEQNRSKTTVLARRSGSHLKSQHFGRPKWADHEVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 743220 - protein, 342 aa, Homo sapiens
RGDLEDPEAQQWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 743221 - protein, 468 aa, Homo sapiens; identical to SEQ ID NO: 743206

SEQ ID NO: 743222 - protein, 176 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQKPASHDMKLHGRGSLWGRKPRSWLQPARMLDSPSPHLCMATPSQPCGETVPWNHSTPCIPTLHSIFHPPPTF

SEQ ID NO: 743223 - protein, 422 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQAGGHAMSSLMERTMW

SEQ ID NO: 743224 - protein, 438 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQDVSVYKTDTVPTLIELTGRRGRKMLNKSFWN

SEQ ID NO: 743225 - protein, 467 aa, Homo sapiens
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 743226 - protein, 179 aa, Homo sapiens
HIIMILVKLASDALFSKKCYNYSFLLLSSSFSLKRTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPGIFAF

SEQ ID NO: 743227 - protein, 467 aa, Homo sapiens; identical to SEQ ID NO: 743225

SEQ ID NO: 743228 - protein, 512 aa, Homo sapiens
MAGTVGVVWIRGGGEAARQPAARQPPGGSIQEAVFLAWLAAFGKNMSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 743229 - protein, 467 aa, Homo sapiens; identical to SEQ ID NO: 743225

SEQ ID NO: 743230 - protein, 467 aa, Homo sapiens; identical to SEQ ID NO: 743225

SEQ ID NO: 743231 - protein, 504 aa, Homo sapiens
AAGGGAGRRQREVGRRWPATPRAPLAPRPFPRCSASFLSSSAPSVFHTRPARLSAGVPRALTGGWRRQSAGGRVPAPGLRRRIGGARSPGWQAGLPARPRRRRSSSPASSPPAAGSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 743232 - protein, 227 aa, Homo sapiens
MDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 743233 - protein, 461 aa, Homo sapiens
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRYEIHIWFLNFHSVIMFHCILAYSGVHLYLFSMRL

SEQ ID NO: 743234 - protein, 467 aa, Homo sapiens; identical to SEQ ID NO: 743225

SEQ ID NO: 743235 - protein, 437 aa, Homo sapiens
MSSILPFTPPVVKRLLGWKKSAGGSGGAGGGEQNGQEEKWCEKAVKSLVKKLKKTGRLDELEKAITTQNCNTKCVTIPRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 743236 - protein, 154 aa, Homo sapiens
MSSILPFTPPVVKRLLGWKKSAGGSGGAGGGEQNGQEEKWCEKAVKSLVKKLKKTGRLDELEKAITTQNCNSCNLKIFNNQEFAALLAQSVNQGFEAVYQLTRMCTIRMSFVKGWGAEYRYEIHIWFLNFHSVIMFHCILAYSGVHLYLFSMRL

SEQ ID NO: 743237 - protein, 132 aa, Homo sapiens
VRACAPRPQCPRFLCVPRSPLALVPRLWPPVGENRGACGAGRRRAGPAPKRARGCAGQAEAQAGIPEHDPRSRRRWGPRGRPGGDDGGGEGAAGPGPGPCASSTARPRLRRTVSPRETDLGSGRDAPPGFVP

SEQ ID NO: 743238 - protein, 501 aa, Homo sapiens
MNKSLGPVSFKDVAVDFTQEEWQQLDPEQKITYRDVMLENYSNLVSVGYHIIKPDVISKLEQGEEPWIVEGEFLLQSYPDEVWQTDDLIERIQEEENKPSRQTVFIETLIEERGNVPGKTFDVETNPVPSRKIAYKNSLCDSCEKCLTSVSEYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECTECGKKFYHKSAFNSHQRIHRRGNMNVIDVGRLL

SEQ ID NO: 743239 - protein, 697 aa, Homo sapiens
MNKSLGPVSFKDVAVDFTQEEWQQLDPEQKITYRDVMLENYSNLVSVGYHIIKPDVISKLEQGEEPWIVEGEFLLQSYPDEVWQTDDLIERIQEEENKPSRQTVFIETLIEERGNVPGKTFDVETNPVPSRKIAYKNSLCDSCEKCLTSVSEYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 743240 - protein, 546 aa, Homo sapiens
RGSSHWVRVPRMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 743241 - protein, 117 aa, Homo sapiens
MNKSLGPVSFKDVAVDFTQEEWQQLDPEQKITYRDVMLENYSNLVSVGYHIIKPDVISKLEQGEEPWIVEGEFLLQSYPGVLVEAVRRSVTWECFSQGFFNGPEPLEVTRNSCLYAL

SEQ ID NO: 743242 - protein, 248 aa, Homo sapiens
VDPLNASPENRNNQGTVNWSVDDIVKGINSSNVENQLQATQAARKLLSREKQPPIDNIIRAGLIPKFVSFLGRTDCSPIQFESAWALTNIASGTSEQTKAVVDGGAIPAFISLLASPHAHISEQAVWALGNIAGDGSVFRDLVIKYGAVDPLLALLAVPDMSSLACGYLRNLTWTLSNLCRNKNPAPPIDAVEQILPTLVRLLHHDDPEVLADTCWAISYLTDGPNERIGMVGENRNCAPTCEASRSF

SEQ ID NO: 743243 - protein, 73 aa, Homo sapiens
AVIAPLCAPVVPPHIPRAGHKKFVLNGTAEGQHPWVHSTFNGEPQSLSSSVRRHPRHLNRGEAPSDVDLEKLW

SEQ ID NO: 743244 - protein, 71 aa, Homo sapiens
RHSPPLCPRRTATHPSSGTLEVRSEWNSRKDSTPGSTAPSTASPRACLHQSVLKAEHSQYDNRSRITARML

SEQ ID NO: 743245 - protein, 78 aa, Homo sapiens
NRQEMNVAMNGTAGRTAPLGPQHLQRRAPEPVFISQETSEASEQGRGTIRCGFRKALVIVCSNNDGWSVEVLKAEHSQ

SEQ ID NO: 743246 - protein, 90 aa, Homo sapiens
QVTSVLCILMPSAGKRCNSCPWGVVQVTELDCRVPGSLPCTERTLGVSTRMSRFCLIWGKGLSRTSLSLGLLCTIVWIPLSSSVRVVKTK

SEQ ID NO: 743247 - protein, 114 aa, Homo sapiens
ASEVEDPKTGGRCELQDFPSSAILRSAVPACCYGDGRQRPSLSMATGGKSFWRTGMGGHFKRAQGLSSADPPPCFGETAPEIMYLSAKHNKKDRKLNGRIEARLKVEIPSETVE

SEQ ID NO: 743248 - protein, 235 aa, Homo sapiens
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 743249 - protein, 235 aa, Homo sapiens; identical to SEQ ID NO: 743248

SEQ ID NO: 743250 - protein, 74 aa, Homo sapiens
RRKERKKKEERKRREKKEEPVLSEHGFGPITTDIREGQTFYYAEDYHQQYLSKNPNGYCGLGGTGVSCPVGIKK

SEQ ID NO: 743251 - protein, 69 aa, Homo sapiens
KTINHNISKEKKKVEVLSEHGFGPITTDIREGQTFYYAEDYHQQYLSKNPNGYCGLGGTGVSCPVGIKK

SEQ ID NO: 743252 - protein, 70 aa, Homo sapiens
SIRRIENLLYLVDMRLVLSEHGFGPITTDIREGQTFYYAEDYHQQYLSKNPNGYCGLGGTGVSCPVGIKK

SEQ ID NO: 743253 - protein, 69 aa, Homo sapiens
YIIIQFNQTQINHSSVLSEHGFGPITTDIREGQTFYYAEDYHQQYLSKNPNGYCGLGGTGVSCPVGIKK

SEQ ID NO: 743254 - protein, 169 aa, Homo sapiens
MAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 743255 - protein, 192 aa, Homo sapiens
MCSEPKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 743256 - protein, 192 aa, Homo sapiens
MSTVAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 743257 - protein, 169 aa, Homo sapiens; identical to SEQ ID NO: 743254

SEQ ID NO: 743258 - protein, 169 aa, Homo sapiens; identical to SEQ ID NO: 743254

SEQ ID NO: 743259 - protein, 102 aa, Homo sapiens
MRRARPKGDPLHIPSHASAHCSPGPSVPPLAGAVSLAWELMAPFCVPTVLSEHGFGPITTDIREGQTFYYAEDYHQQYLSKNPNGYCGLGGTGVSCPVGIKK

SEQ ID NO: 743260 - protein, 144 aa, Homo sapiens
KWNCVEERICHLQRENAWLVQQLDDVHQKEDHKEIVTNIQRGFIESGKKDLVLEEKSKKLMNECDHLKESLFQYEREKTEGVVVVRQLQQEVADSVKKLTTLESPLEGISRCHINLDETQASNKKLFQVKSQICMEFNMSTVIL

SEQ ID NO: 743261 - protein, 106 aa, Homo sapiens
LGAGSQRGAAPECGENHQAPELGSTWRGQRLQPQTAALCHFALRKLPGNAHGLAAAFVQPALQVQEEKNNRTRFSGAYFTMSDPDMRLCLQSATWNIQTSDQHHRL

SEQ ID NO: 743262 - protein, 144 aa, Homo sapiens
SLPHRIGIFFCPLLPFIQMIMLFIMFYLNSQKKAIGPEAGRPAPVQGAPPAGCFGPGSTRGPAQAAATGAPGGHEALPAVSNLEYSDFRPASQIITLRKSSASQLPSKASLKDPWTRDSSVLNNILRSSWFAQHLHLLGTKQEQ

SEQ ID NO: 743263 - protein, 112 aa, Homo sapiens
MYGGSGSCRVIQHFGRPMTGGSLEVREFGTSLASMVKPHLYYKYKKISPVHARAPRQEGRLRCRERRLRAASGQGRPEGQRKQRQQERQEDMRLCLQSATWNIQTSDQHHRL

SEQ ID NO: 743264 - protein, 132 aa, Homo sapiens
QDQAGQHSETLSVVVRFHAADKDIPKTGQFIKKRGLMDLQFHVAADASQSWQKARRSKSRLTWMAVGKMRESLCRETPPYKAIRSHETYSHENSTGKTMIILPPTGSLPQYVGIQEETWVGTQPNHVTVSKK

SEQ ID NO: 743265 - protein, 57 aa, Homo sapiens
KQLEPTVQSLEMKSKTARNTPNWVNQSLDFHNHEEMKGLMDENCILKADIAILRQEI

SEQ ID NO: 743266 - protein, 324 aa, Homo sapiens
REGHYPEPAHLSANARRLIVHLLAPNPAERPSLDHLLQDDFFTQGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRRVSFSGVPAQLVLSGEGEGLQLTLWEQGSPGTSYSLDVPRKPRLRPHHRTAPSPRPPHAAEYLVPLRVRVDPCMVVPGTQAPFPFLWLPQRGCPGGGLGGTREVGSCLVA

SEQ ID NO: 743267 - protein, 380 aa, Homo sapiens
REGHYPEPAHLSANARRLIVHLLAPNPAERPSLDHLLQDDFFTQVGGGPRRGVPGVGSLAGDEPEPALLSRGRPRPVPGNPGAQGLGDLKPGITPNPHPKGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRRVSFSGVPAQLVLSGEGEGLQLTLWEQGSPGTSYSLDVPRKPRLRPHHRTAPSPRPPHAAEYLVPLRVRVDPCMVVPGTQAPFPFLWLPQRGCPGGGLGGTREVGSCLVA

SEQ ID NO: 743268 - protein, 192 aa, Homo sapiens
REGHYPEPAHLSANARRLIVHLLAPNPAERPSLDHLLQDDFFTQVGGGPRRGVPGVGSLAGDEPEPALLSRGRPRPVPGNPGAQGLGDLKPGITPNPHPKGFTPDRLPAHSCHSPPIFAIPPPLGRIFRKVGQRLLTQCRPPCPFTPKEASGPGEGGPDPDSMEWDGEVRHRGGGHGETQVEGMLAPAKTPS

SEQ ID NO: 743269 - protein, 61 aa, Homo sapiens
MVDVSQPEGTSRRVPGMNREIPKDPKGYAERRAARHTQDQHLSVFHANPRRDTSSLLCRTP

SEQ ID NO: 743270 - protein, 61 aa, Homo sapiens; identical to SEQ ID NO: 743269

SEQ ID NO: 743271 - protein, 524 aa, Homo sapiens
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRRTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 743272 - protein, 437 aa, Homo sapiens
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRRTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLVHLCSSPSCPQGFVSNTLPDLPLSQSLPSVHSISTSGFASVGAQGSGITSDVLPTS

SEQ ID NO: 743273 - protein, 206 aa, Homo sapiens [sequence omitted]

SEQ ID NO: 743274 - protein, 517 aa, Homo sapiens
GDGAAAILWGVCRSGRGGKTAVWRHFSAEGPFAFAEMRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSKSHRRKRSRSIEDDEEGHLICQSGDVLRARYEIVDTLGEGAFGKVVECIDHGMDGMHVAVKIVKNVGRYREAARSEIQVLEHLNSTDPNSVFRCVQMLEWFDHHGHVCIVFELLGLSTYDFIKENSFLPFQIDHIRQMAYQICQSINFLHHNKLTHTDLKPENILFVKSDYVVKYNSKMKRDERTLKNTDIKVVDFGSATYDDEHHSTLVSTRHYRAPEVILALGWSQPCDVWSIGCILIEYYLGFTVFQTHDSKEHLAMMERILGPIPQHMIQKTRKRKYFHHNQLDWDEHSSAGRYVRRRCKPLKEFMLCHDEEHEKLFDLVRRMLEYDPTQRITLDEALQHPFFDLLKKK

SEQ ID NO: 743275 - protein, 299 aa, Homo sapiens
FLDNSLKTTENVTDPTLQNNCYSVLKRSQLRDSRDCVTSFVSFDLESLSRTMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGDEIVDTLGEGAFGKVVECIDHKAGGRHVAVKIVKNVDRYCEAARSEIQVLEHLNTTDPNSTFRCVQMLEWFDHHGHVCIVFELLGLSTYDFIKENSFLPFQIDHIRQMAYQICQSINL

SEQ ID NO: 743276 - protein, 517 aa, Homo sapiens; identical to SEQ ID NO: 743274

SEQ ID NO: 743277 - protein, 102 aa, Homo sapiens
RGCECACVCARTAVVIMMYLLAVYRWLSFHSTIFWLTSVSCESSVVTLCIEWISWYLKIAEALMQAAHEPVESVPLQPRQTHLPTLNMPSLVAMNPNVSKNR

SEQ ID NO: 743278 - protein, 78 aa, Homo sapiens
KLPGSPAPAPASLSVPSKTVISKPRHLWEQPLASCPALCNQPVLTPTREEESALVNPLVYQARFPGCSRETNCCSRKS

SEQ ID NO: 743279 - protein, 116 aa, Homo sapiens
MGLLPPPWTISFTVQTTLQPPGGLPAAPVSGRMAFEPVGRDLARRMVPRAGKRTQTLGARRVAAQGPGPLPEDRRPKSGERLHVTVAPCWEFVLPSVSLTAQAWGGVGQEASSGVP

SEQ ID NO: 743280 - protein, 116 aa, Homo sapiens; identical to SEQ ID NO: 743279

SEQ ID NO: 743281 - protein, 818 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 743282 - protein, 818 aa, Homo sapiens; identical to SEQ ID NO: 743281

SEQ ID NO: 743283 - protein, 818 aa, Homo sapiens; identical to SEQ ID NO: 743281

SEQ ID NO: 743284 - protein, 818 aa, Homo sapiens; identical to SEQ ID NO: 743281

SEQ ID NO: 743285 - protein, 818 aa, Homo sapiens; identical to SEQ ID NO: 743281

SEQ ID NO: 743286 - protein, 818 aa, Homo sapiens; identical to SEQ ID NO: 743281

SEQ ID NO: 743287 - protein, 818 aa, Homo sapiens; identical to SEQ ID NO: 743281

SEQ ID NO: 743288 - protein, 701 aa, Homo sapiens
MTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 743289 - protein, 341 aa, Homo sapiens [sequence omitted]

SEQ ID NO: 743290 - protein, 405 aa, Homo sapiens
RTRGSRTRGFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 743291 - protein, 864 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGIVLGIITKKNILEHLEQLKQHVEAPPWHYNKKRYPPAYGPDGKPRPRFNNVQLNLTDEEREETEEEVYLLNSTTL

SEQ ID NO: 743292 - protein, 818 aa, Homo sapiens; identical to SEQ ID NO: 743281

SEQ ID NO: 743293 - protein, 85 aa, Homo sapiens
VQASVGDDVLRPMIRGMMDEKGTQFVAYFLPVEETLKKRKRPGNRPQTGSLPLSSLRFNNVQLNLTDEEREETEEEVYLLNSTTL

SEQ ID NO: 743294 - protein, 352 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEQGLALFFNQNCSV

SEQ ID NO: 743295 - protein, 818 aa, Homo sapiens; identical to SEQ ID NO: 743281

SEQ ID NO: 743296 - protein, 821 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGIVLGIITKKNILEHLEQLKQHVEHQDSCTTQD

SEQ ID NO: 743297 - protein, 737 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIGTLSKIYICIYEMDFWKKGKQ

SEQ ID NO: 743298 - protein, 732 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGEFLLVVSNLLIRVLVLGLSGRKLKRIQ

SEQ ID NO: 743299 - protein, 146 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGFA

SEQ ID NO: 743300 - protein, 111 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRFTYTL

SEQ ID NO: 743301 - protein, 117 aa, Homo sapiens
RGWAHPILERVARLSLPPRTPKCGRVGPLTLSWAPGAVSCLHLGCTCQAPWVPCAPHPFTRGHCLIPAPAPTLRPSGEAPAPTCLSEQERGPSRPACSGCGFLGTGGSWVGIWRMLL

SEQ ID NO: 743302 - protein, 94 aa, Homo sapiens
LLRDLSPPACRWELGHLLRLSALASSAVYVKGSHRASSGHHGEQEARKEGSNVGKRAQMTTKQNGFPPWASFPHTQHRGYFKINKINVQTCTEA

SEQ ID NO: 743303 - protein, 104 aa, Homo sapiens
HEIQHFWPRSLNHSRSTRGGWSTTPSSYPGTELNARTTPNEGATIFPLTSSLGQQDKLRTACPGPTREAGGRPLSTVSHLVHPAVTMVNKKPGRKEAMSAKGLR

SEQ ID NO: 743304 - protein, 76 aa, Homo sapiens
WFISFLISSQISSPALLPYLKLPLILSLSCYTALFIFFIELTYISMLLSISIYFPVYFLFQGFADYCGSNQACLVP

SEQ ID NO: 743305 - protein, 189 aa, Homo sapiens
LKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPASLDHEAPSLQEAALAAACSNRLCKLPSFISLQSSPSPGAQPRVRAPRAPLTKDSGKPLHIKPRL

SEQ ID NO: 743306 - protein, 189 aa, Homo sapiens; identical to SEQ ID NO: 743305

SEQ ID NO: 743307 - protein, 189 aa, Homo sapiens; identical to SEQ ID NO: 743305

SEQ ID NO: 743308 - protein, 271 aa, Homo sapiens
MDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743309 - protein, 400 aa, Homo sapiens
MEDYLQGCRAALQESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743310 - protein, 453 aa, Homo sapiens
MEDYLQGCRAALQESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743311 - protein, 370 aa, Homo sapiens
MEDYLQGCRAALQESRPLHVVLGNEACDLDSTVSALALAFYLAKKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743312 - protein, 397 aa, Homo sapiens
GKIGPLRKIDESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743313 - protein, 189 aa, Homo sapiens
MIYLIPYKRQSLMYQGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743314 - protein, 484 aa, Homo sapiens
MEDYLQGCRAALQESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTGQSLAMLPRLVSNSWTQVIHQPQLPRVLELQICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743315 - protein, 423 aa, Homo sapiens
MEDYLQGCRAALQESRPLHVVLGNEACDLDSTVSALALAFYLAKKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743316 - protein, 221 aa, Homo sapiens
MLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743317 - protein, 308 aa, Homo sapiens
MEDYLQGCRAALQESRPLHVVLGNEACDLDSTVSALALAFYLAKKVHIPESILIFRDEIDLHALYQAGQLTLILVDHHILSKLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743318 - protein, 221 aa, Homo sapiens; identical to SEQ ID NO: 743316

SEQ ID NO: 743319 - protein, 241 aa, Homo sapiens
QAEFYSQRPKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743320 - protein, 199 aa, Homo sapiens
MRLTSMHYTRLANSPSSLSTIISYPRLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743321 - protein, 311 aa, Homo sapiens
MEDYLQGCRAALQESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTT

SEQ ID NO: 743322 - protein, 189 aa, Homo sapiens; identical to SEQ ID NO: 743313

SEQ ID NO: 743323 - protein, 168 aa, Homo sapiens
MLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 743324 - protein, 221 aa, Homo sapiens; identical to SEQ ID NO: 743316

SEQ ID NO: 743325 - protein, 453 aa, Homo sapiens; identical to SEQ ID NO: 743310

SEQ ID NO: 743326 - protein, 453 aa, Homo sapiens; identical to SEQ ID NO: 743310

SEQ ID NO: 743327 - protein, 453 aa, Homo sapiens; identical to SEQ ID NO: 743310

SEQ ID NO: 743328 - protein, 414 aa, Homo sapiens
MEDYLQGCRAALQESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFLENQENTQKGLNDLIGTLPKRQQNWNERPGSVSCLSRPINFLSISFFPCSH

SEQ ID NO: 743329 - protein, 369 aa, Homo sapiens
MEDYLQGCRAALQESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPPKGRIRHEDHSDVGAA

SEQ ID NO: 743330 - protein, 162 aa, Homo sapiens
MAFMKKYLLPILGLFMAYYYYSANEEFRPEMLQGKKVIVTGASKGIGREMAYHLAKMGAHVVVTASSAHYIAGTMEDMTFAEQFVAQAGKLMGGLDMLILNHITNTSLNLFHDDIHHVRKSMEVNFLSYVVLTVAALPMLKQSNGSMCALLLECYHVVHLSS

SEQ ID NO: 743331 - protein, 292 aa, Homo sapiens
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 743332 - protein, 262 aa, Homo sapiens
MLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 743333 - protein, 292 aa, Homo sapiens; identical to SEQ ID NO: 743331

SEQ ID NO: 743334 - protein, 292 aa, Homo sapiens; identical to SEQ ID NO: 743331

SEQ ID NO: 743335 - protein, 295 aa, Homo sapiens
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMEGLFCLMFI

SEQ ID NO: 743336 - protein, 274 aa, Homo sapiens
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 743337 - protein, 274 aa, Homo sapiens
MAFMKKYLLPILGLFMAYYYYSANEEFRPEMLQGKKVIVTGASKGIGREMAYHLAKMGAHVVVTASSAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 743338 - protein, 244 aa, Homo sapiens
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAETAMKAVSGIVHMQAAPKEECALEIIKGGALRQEEVYYDSSLWTTLLIRNPCRKILEFLYSTSYNMDRFINK

SEQ ID NO: 743339 - protein, 260 aa, Homo sapiens
YHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRGGPKWRSC

SEQ ID NO: 743340 - protein, 84 aa, Homo sapiens
DSPAHLSCHHGFLRGVASRGWRDVGMSHWLHVKGPSCPPHCHTDASRLGLGSRSIPAHHTATQVVLGRGWACAPCCCRHCAVSM

SEQ ID NO: 743341 - protein, 79 aa, Homo sapiens
MILAWRLPLIYPHVSLFIPQLSGQTNIHLSKNFFLTNRARERSDTFINLREVLNRFKLPPGEYILVPSTFEPNKDGDFC

SEQ ID NO: 743342 - protein, 192 aa, Homo sapiens
MKSFLPVHTIVLIRENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEVPVGQEEVC

SEQ ID NO: 743343 - protein, 85 aa, Homo sapiens
SKHYWGIGWTQTLNNSSFNPHNHPLRYVGTILIIPNLQMSKLRHREVQKLAQAQTDLEQGQLGFKVCGLSHLASSAASPFQNVRT

SEQ ID NO: 743344 - protein, 69 aa, Homo sapiens
DTLCLLQCQVNIAEICLVSPCTPGCRGAPAASSGAGGGLTAILGSLPAVSLLSSVHWEEGVRCGCVEPS

SEQ ID NO: 743345 - protein, 127 aa, Homo sapiens
MPEDRMSLRQELGPALMPASANAKSTNAPLARRVSVGAFPGESGCLGRVRGGNRELSRQEQDSDKLPHIPFLTAAPATLWAVPSVPKAAFAKGHQISAAAVPDAGTALLTDVERVTYINLEFFSMQP

SEQ ID NO: 743346 - protein, 70 aa, Homo sapiens
VKANKHQIRQAVKKLYDSDVAKVTTLICPDKEKAYVRLAPDYDAFDVVTKLGSPKLSQLANSKYMCIFSA

SEQ ID NO: 743347 - protein, 144 aa, Homo sapiens
RSPGNGCGLAHVMAPEENAGTELLLQGFERRFLAVRTLRSFPWQTVRHPVCVKHPPSVKYAWFFLSELIKKSSGGSVTLSKSTAIISHGTTGLVTWDAALYLAEWAIENPAALINRRAVLPRSHRVAGRGPAEAGCLPGAQAGS

SEQ ID NO: 743348 - protein, 138 aa, Homo sapiens
RSPGNGCGLAHVMAPEENAGTELLLQGFERRFLAVRTLRSFPWQSLEAKLRDSSYSELLRDILQKSSGGSVTLSKSTAIISHGTTGLVTWDAALYLAEWAIENPAALINRRAVLPRSHRVAGRGPAEAGCLPGAQAGS

SEQ ID NO: 743349 - protein, 102 aa, Homo sapiens
MPPSTLQNGPSRTRQPSLTDVLYCPEAIVSLVGVLQRLAACREHKRAPEVYVAFTVRNPETCQLFTTELGRDGIRWEAEAHHDQKLFPYGEHLEMAMLNLTL

SEQ ID NO: 743350 - protein, 107 aa, Homo sapiens
RSPGNGCGLAHVMAPEENAGTELLLQGFERRFLASSGGSVTLSKSTAIISHGTTGLVTWDAALYLAEWAIENPAALINRRAVLPRSHRVAGRGPAEAGCLPGAQAGS

SEQ ID NO: 743351 - protein, 128 aa, Homo sapiens [sequence omitted]

SEQ ID NO: 743352 - protein, 103 aa, Homo sapiens
PKQVSIKQSWGTVGGHRADFQEVTSGVLAASNPEMRKVSPKGHLEVIPRSRWRWPEILWSSVQMSLHFGLLTFHNTNNFVLVEIVFFCQNPTFILNSANLRET

SEQ ID NO: 743353 - protein, 115 aa, Homo sapiens
KRSCTVRNSRIAQKGKNYQNGDVFGDEYRIKPVEEVKYMKNGAEEEQKIAARNQENLEKSASSNVRLKTNKEVPGLVHQPRANMHISESQQEFFRMLDEKIEKGRDYCSEEEDIT

SEQ ID NO: 743354 - protein, 150 aa, Homo sapiens
ERGAPLPRSLLASSRSLPAHSRGDVPCRGRRGRCFFHTLVGSCAPRSVTGELAARRRLPHACTRARLRGFGFLLQAAGRRGSPGHTVGRRRKKRRREEEKRRGGQGRGAGASKDFEATEGNPTDQAGFSEDRDFGYSVGLNPAEEEAVTS

SEQ ID NO: 743355 - protein, 862 aa, Homo sapiens
MKRILQCTCWCTLLVVISVGLRSWKEEGRVSGLVSGGRKMMRNELRALSREGDRLAVSGVKLEIQLPSGQWVGKTVNEIYSWLTHALCPLSCRVVKVQQCVHSFLLVGRDSGSWSTALIIEDVFVIGRDTLKKAFTSAMLPSPRLAENTEWCCGLFRDKEGIKSRDEKTGSALRNCSSHAHRSLLEDRSLSVHSAHHLSLGWDDSTCKDGPRRSAGSSVFVLAPSSPHCNVRKHLCVRAHLGIQSGHAHNPTAPRSRSRDDAAPFLVPCDVILLCYLLITLSCYNFILFPASSLFFCYGQDSSISLLKNRDDTSYKLYLIACEAGWHVDYKSCFDTGQEFKIVLSLLVIEKKALLNMLSFKGRNIFKFLSKKILSWNLRLRDSDTFFMKGKIIGIKVLSFLPPLKKKDIRLHTIILHKICLPHFPAGRHSQSFDVFVPLRDWTFSCLKPQPKKIIRHDWWGGNVYLGANKKVARSRNFGLMVSWVDDLDSSVPVRGWVRQSAVTLTCACNKPFGISGTRYELPFANEWMYFSKGGIVSLTLAVTFLYVSRKGSKNYGKDEAYEVNTSGTNLRTHKLCHVFQETLYLIWNLILGEEEKGANICHLYSLCARYCARHFIIVCVILMISVKLIYYPRVLNNEILSVECIYPTEMPMLKEGKMSFKYFSNSFYYDYALRNTVKTTPGGICLPESLSGFSPAWFPHGECFIWPPLSELHTHQGRPLANSRTSVPRGKGFGNLGTRFSPWNPSSIWKRNLVFLQLDTRCNQNRLSSAVISFLGSQVLLFITNCIFLRLKVLTFMGVWDNPISKHGGKAMPGPLTCIEILSCGLGFDVIFFIFGLGICIFQVHLSTETRCKSLSRPYMF

SEQ ID NO: 743356 - protein, 823 aa, Homo sapiens
MMRNELRALSREGDRLAVSGVKLEIQLPSGQWVGKTVNEIYSWLTHALCPLSCRVVKVQQCVHSFLLVGRDSGSWSTALIIEDVFVIGRDTLKKAFTSAMLPSPRLAENTEWCCGLFRDKEGIKSRDEKTGSALRNCSSHAHRSLLEDRSLSVHSAHHLSLGWDDQLSKDGPRRSAGSSVFVLAPSSPHCNVRKHLCVRAHLGIQSGHAHNPTAPRSRSRDDAAPFLVPCDVILLCYLLITLSCYNFILFPASSLFFCYGQDSSISLLKNRDDTSYKLYLIACEAGWHVDYKSCFDTGQEFKIVLSLLVIEKKALLNMLSFKGRNIFKFLSKKILSWNLRLRDSDTFFMKGKIIGIKVLSFLPPLKKKDIRLHTIILHKICLPHFPAGRHSQSFDVFVPLRDWTFSCLKPQPKKIIRHDWWGGNVYLGANKKVARSRNFGLMVSWVDDLDSSVPVRGWVRQSAVTLTCACNKPFGISGTRYELPFANEWMYFSKGGIVSLTLAVTFLYVSRKGSKNYGKDEAYEMNTSGTNLRTHKLCHVFQETLYLIWNLILGEEEKGANICHLYSLCARYCARHFIIVCVILMISVKLIYYPRVLNNEILSVECIYPTYMPMLKEGKMSFKYFSNSFYYDYALRNTVKTTPGGICLPESLSGFSPAWFPHGECFIWPPLSELHTHQGRPLANSRTSVPWGKGFGNLGTRFSPWNPSSIWKRNLVFLQLDTRCNQNRLSSAVISSWVPKSCCFITNCIFLRLKVLTFMGVWDNPISKHGGKAMPGPLTCIEILSCGLGFDVIFFIFGLGICIFQVHLSTETRCKSLSRPYMF

SEQ ID NO: 743357 - protein, 812 aa, Homo sapiens
MAGRVRGEIGNASCLVASGWGKTVNEIYSWLTHALCPLSCRVVKVQQCVHSFLLVGRDSGSWSTALIIEDVFVIGRDTLKKAFTSAMLPSPRLAENTEWCCGLFRDKEGIKSRDEKTGSALRNCSSHAHRSLLEDRSLSVHSAQSSEPGLEMTQLSKDGPRRSAGSSVFVLAPSSPHCNVRKHLCVRAHLGIQSGHAHNPTAPRSRSRDDAAPFLVPCDVILLCYLLITLSCYNFILFPASSLFFCYGQDSSISLLKNRDDTSYKLYLIACEAGWHVDYKSCFDTGQEFKIVLSLLVIEKKHCYNMLSFKGRNIFKFLIQENTEWNLRLRDSDTFFMKGKIIGIKVLSFLPPLKKKDIRLHTIILHKICLPHFPAGRHSQSFDVFVPLRDWTFSCLKPQPKKIIRHDVVGRECVFRGIIKRWLEAGTLASWCHGWMPGLQCACEGLGYGSRLSHSHVPAINLLEFHERGDELPFANEWMYFSKGGIVSLTLAVTFLYVSRKGSKNYGKDEAYEMNTSGTNLRTHKLCHVFQETLYLIWNLILGEEEKGANICHLYSLCARYCARHFIIVLCHLMISVKLIYYPRVLNNEILSVECIYPTEMPMLKEGKMSFKYFSNSFYYDYALRNTVKTTPGGICLPESLSGFSPAWFPHGECFIWPPLSELHTHQGRPLANSRTSVPWGKGFGNLGTRFSPWNPSSIWKRNLVFLQLDTRCNQNRLSSAVISFLVPKSCCFITNCIFLRLKVLTFMGVWDNPISKHGGKAMPGPLTCIEILSCGLGFDVIFFIFGLGICIFQVHLSTETRCKSLSRPYMF

SEQ ID NO: 743358 - protein, 121 aa, Homo sapiens
MGCASAKHVATVQNEEEAQKGKNYQNGDVFGDEYRIKPVEEVKYMKNGAEEEQKIAARNQENLEKSASSNVRLKTNKEVPGLVHQPRANMHISESQQEFFRMLDEKIEKGRDYCSEEEDIT

SEQ ID NO: 743359 - protein, 121 aa, Homo sapiens; identical to SEQ ID NO: 743358

SEQ ID NO: 743360 - protein, 810 aa, Homo sapiens
MAGRVRGEIGNASCLVASGWGKTVNEIYSWLTHALCPLSCRVVKVQQCVHSFLLVGRDSGSWSTALIIEDVFVIGRDTLKKAFTSAMLPSPRLAENTEWCCGLFRDKEGIKSRDEKTGSALRNCSSHAHRSLLEDRSLSVHSAHHLSLGWDDQLSKDGPRRSAGSSVFVLAPSSPHCNVRKHLCVRAHLGIQSGHAHNPTAPRSRSRDDAAPFLVPCDVILLCYLLITLSCYNFILFPASSLFFCYGQDSSISLLKNRDDTSYKLYLIACEAGWHVDYKSCFDTGQEFKIVLSLLVIEKKALLNMLSFKGRNIFKFLSKKILSWNLRLRDSDTFFMKGKIIGIKVLSFLPPLKKKDIRLHTIILHKICLPHFPAGRHSQSFDVFVPLRDWTFSCLKPQPKKIIRHDWWGGNVYLGANKKVARSRNFGLMVSWVDDLDSSVPVRGWVRQSAVTLTCACNKPFGISGTRYELPFANEWMYFSKGGIVSLTLAVTFLYVSRKGSKNYGKDEAYEMNTSGTNLRTHKLCHVFQETLYLIWNLILGEEEKGANICHLYSLCARYCARHFIIVCVILMISVKLIYYPRVLNNEILSVECIYPTYMPMLKEGKMSFKYFSNSFYYDYALRNTVKTTPGGICLPESLSGFSPAWFPHGECFIWPPLSELHTHQGRPLANSRTSVPWGKGFGNLGTRFSPWNPSSIWKRNLVFLQLDTRCNQNRLSSAVISSWVPKSCCFITNCIFLRLKVLTFMGVWDNPISKHGGKAMPGPLTCIEILSCGLGFDVIFFIFGLGICIFQVHLSTETRCKSLSRPYMF

SEQ ID NO: 743361 - protein, 121 aa, Homo sapiens; identical to SEQ ID NO: 743358

SEQ ID NO: 743362 - protein, 95 aa, Homo sapiens
AHASGEFLRHLSNPSSMQVLSKDDCVCFQVASVKAALGTIIIEEGTNTSNKRTFVSFKTKEKETKTSPNFNDLVGFFRKRSFNATSSLRRLRLAR

SEQ ID NO: 743363 - protein, 295 aa, Homo sapiens
MGSPEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGGLAVGTLCGDALLHLLPHAQEGRHAGPGGLPEKDLGPGLSVLGGLFLLFVLENMLGLLRHRGLRPVSDTLFSSFC

SEQ ID NO: 743364 - protein, 324 aa, Homo sapiens
MGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGGLAVGTLCGDALLHLLPHAQEGRHAGPGGLPEKDLGPGLSVLGGLFLLFVLENMLGLLRHRGLRPVSDTLFSSFC

SEQ ID NO: 743365 - protein, 325 aa, Homo sapiens
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGGLAVGTLCGDALLHLLPHAQEGRHAGPGGLPEKDLGPGLSVLGGLFLLFVLENMLGLLRHRGLRPVSDTLFSSFC

SEQ ID NO: 743366 - protein, 324 aa, Homo sapiens; identical to SEQ ID NO: 743364

SEQ ID NO: 743367 - protein, 361 aa, Homo sapiens
ISLLLLACICYGDQCSRWEERQYHPNMIRNHHHPSPMMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGGLAVGTLCGDALLHLLPHAQEGRHAGPGGLPEKDLGPGLSVLGGLFLLFVLENMLGLLRHRGLRPVSDTLFSSFC

SEQ ID NO: 743368 - protein, 252 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 743369 - protein, 252 aa, Homo sapiens; identical to SEQ ID NO: 743368

SEQ ID NO: 743370 - protein, 252 aa, Homo sapiens; identical to SEQ ID NO: 743368

SEQ ID NO: 743371 - protein, 252 aa, Homo sapiens; identical to SEQ ID NO: 743368

SEQ ID NO: 743372 - protein, 167 aa, Homo sapiens
AARAARAARGSLSRAAPVTEMASSLKIWGTLLALLCILCTLLVQSKEVSWREFMKQHYLSPSREFREYKCDVLMRENEALKDKSSHMFIYISWYKIEHICTSDNWMDRFRNAYVWVQNPLKVLKCHQENSKNSYTESRSFNYIEFHCSMDGYVDSIEDLKMVEPIGN

SEQ ID NO: 743373 - protein, 81 aa, Homo sapiens
DCLVNEPAVFIEHLLCAECWGPWEAECWRNGKATTNDKQQQTLQAGWASPVWGLMNRFFSLTIGFAGFVGFVGKEPFVQNW

SEQ ID NO: 743374 - protein, 235 aa, Homo sapiens
MSCRSGRGMEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPIWTQASGGKAWDPLES

SEQ ID NO: 743375 - protein, 244 aa, Homo sapiens
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASFEKTRGSELFRNLLEIRKVSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPSEPACGERIGTLAGT

SEQ ID NO: 743376 - protein, 582 aa, Homo sapiens
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAIPVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 743377 - protein, 544 aa, Homo sapiens
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAIPVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 743378 - protein, 569 aa, Homo sapiens
MEALSRAGQEMSLAALKQHDPYITSIADLTGQEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAIPVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 743379 - protein, 461 aa, Homo sapiens
MADVVEEETRRSQQAARDKQSPSQANGCSDHRPIDILEMLSRAKDEYERNQMGDSNISSPGLQPSTQLSNLGSTETLEEMPSGSQDKSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAIPVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 743380 - protein, 423 aa, Homo sapiens
MADVVEEETRRSQQAARDKQSPSQANGCSDHRPIDILEMLSRAKDEYERSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAIPVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 743381 - protein, 227 aa, Homo sapiens
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPIWTQASGGKAWDPLES

SEQ ID NO: 743382 - protein, 265 aa, Homo sapiens
MAAAVPKRMRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 743383 - protein, 135 aa, Homo sapiens [sequence omitted]

SEQ ID NO: 743384 - protein, 247 aa, Homo sapiens
MAAAVPKRMRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLSSLKITNDYIF

SEQ ID NO: 743385 - protein, 135 aa, Homo sapiens [sequence omitted]

SEQ ID NO: 743386 - protein, 133 aa, Homo sapiens
PGDLEDPVVVSSNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 743387 - protein, 265 aa, Homo sapiens; identical to SEQ ID NO: 743382

SEQ ID NO: 743388 - protein, 265 aa, Homo sapiens; identical to SEQ ID NO: 743382

SEQ ID NO: 743389 - protein, 265 aa, Homo sapiens; identical to SEQ ID NO: 743382

SEQ ID NO: 743390 - protein, 125 aa, Homo sapiens
PQFCSWMSPKLLFPLIHIKARASVPRACAMQCSAVGDTAGRETGKTGQQWALPSGGFLSRQQCRATLKSMQRGREPHSRKTQKGDRKLPPCTVAHCSSGGPMGSSYSHQGPIAQSAIFSQTIHVF

SEQ ID NO: 743391 - protein, 58 aa, Homo sapiens
MVNLLQIVRDHWVHVLVPMGFVIGCYLDRKSDERLTAFRNKSMLFKRELQPSEEVTWK

SEQ ID NO: 743392 - protein, 88 aa, Homo sapiens
VPRSQLPLARVEFPVALGLGVAVGAEAAAIMVNLLQIVRDHWVHVLVPMGFVIGCYLDRKSDERLTAFRNKSMLFKRELQPSEEVTWK

SEQ ID NO: 743393 - protein, 88 aa, Homo sapiens; identical to SEQ ID NO: 743392

SEQ ID NO: 743394 - protein, 69 aa, Homo sapiens
SASQSAGITAIMVNLLQIVRDHWVHVLVPMGFVIGCYLDRKSDERLTAFRNKSMLFKRELQPSEEVTWK

SEQ ID NO: 743395 - protein, 58 aa, Homo sapiens; identical to SEQ ID NO: 743391

SEQ ID NO: 743396 - protein, 58 aa, Homo sapiens; identical to SEQ ID NO: 743391

SEQ ID NO: 743397 - protein, 68 aa, Homo sapiens
ENMWPSTKQEAGEGWVEKKQECEKIDHRHRCPVEAPRDYPHHCPVEAPRLTQSISTTPLLCVSGGTRH

SEQ ID NO: 743398 - protein, 515 aa, Homo sapiens
MGHNGSWISPNASEPHNASGAEAAGVNRSALGEFGEAQLYRQFTTTVQVVIFIGSLLGNFMVLWSTCRTTVFKSVTNRFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 743399 - protein, 515 aa, Homo sapiens; identical to SEQ ID NO: 743398

SEQ ID NO: 743400 - protein, 577 aa, Homo sapiens
MGHNGSWISPNASEPHNASGAEAAGVNRSALGEFGEAQLYRQFTTTVQVVIFIGSLLDCTSKNLSLNNQTLRVEPGEVNSHSKGKGFPPGTTFPNGASEWAFQGAQHHIIENGTYVSFSGNFMVLWSTCRTTVFKSVTNRFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 743401 - protein, 389 aa, Homo sapiens
LEYKSEVRVLSQEYFRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 743402 - protein, 583 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAAVESIPVFGALCSSSSLHQTLEALARDLTKLDLRRWASFMDAGVEHDDVAELLQELQSLAQCYQGGDSLVD

SEQ ID NO: 743403 - protein, 583 aa, Homo sapiens; identical to SEQ ID NO: 743402

SEQ ID NO: 743404 - protein, 80 aa, Homo sapiens
VEALARSGAGTKRNTVPQTLCSSSSLHQTLEALARDLTKLDLRRWASFMDAGVEHDDVAELLQELQSLAQCYQGGDSLVD

SEQ ID NO: 743405 - protein, 70 aa, Homo sapiens
RCRYLQDPPTLPSSRTGDEELSTTCQHSRGPRQLLKSHFGNRLLGPGDSEDLNCSTPVRPLDVVPPASHS

SEQ ID NO: 743406 - protein, 514 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAGM

SEQ ID NO: 743407 - protein, 532 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSHRLMVVLALFWQPAHPRDTSTLCPSCMYHWGRNLGSVFTTAAAWSHEFFPSAADSLQGGSSLPPPLLKLQSTGYGSGWFPQGSRYVGGEEN

SEQ ID NO: 743408 - protein, 555 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEDCDSVKQKGGYAVWPANSRRTKQPLPLNCLEPNVDFSDPSQGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAGM

SEQ ID NO: 743409 - protein, 527 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDDLRPSAHLGVFLQATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAGM

SEQ ID NO: 743410 - protein, 365 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDVSLGALVLTAAGYRASSCSQSAAVCYWLCS

SEQ ID NO: 743411 - protein, 571 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSHRLMVVLALFWQPAHPRDTSTLCPSCMYHWGRNLGSVFTTAAAWSHEFFPSAADSLQGGSSLPPPLLKLQSTGYGSGWFPQGSSSGEHPSVWGTVFLFVPAPDPGSLGQRPHQTRLAALGQLHGCWSGAR

SEQ ID NO: 743412 - protein, 409 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKLPPPLLKLQSTGYGSGWFPQGSRYVGGEEN

SEQ ID NO: 743413 - protein, 323 aa, Homo sapiens [sequence omitted]

SEQ ID NO: 743414 - protein, 507 aa, Homo sapiens
TFSRPASSSLLPQDAALGRATDSKEPPGELCPDVLYRTGRTLHGQETYTPRLILMDLKGSLSSLKEEGGLYRDKQLDAAIAWQGKLTTHKEELYPKNPYLQDFLSAEVRASVLNFLTRCHNPRVSIGEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAGM

SEQ ID NO: 743415 - protein, 675 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDVSLGALVADCGRLQGLLMLPVSRCLLLALFLRPELELSCDVASQITLSYAVSSLGSNIPLIRPLGLSGVNIAASTHSFPGLRPSAHLGVFLQATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAAVESIPVFGALCSSSSLHQTLEALARDLTKLDLRRWASFMDAGVEHDDVAELLQELQSLAQCYQGGDSLVD

SEQ ID NO: 743416 - protein, 572 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPAVESIPVFGALCSSSSLHQTLEALARDLTKLDLRRWASFMDAGVEHDDVAELLQELQSLAQCYQGGDSLVD

SEQ ID NO: 743417 - protein, 149 aa, Homo sapiens [sequence omitted]

SEQ ID NO: 743418 - protein, 111 aa, Homo sapiens
YTGSRWRHRLKMNTLLCPVSGAEGYRQSMPHKPAHPRDTSTLCPSCMYHWGRNLGSVFTTAAAWSHEFFPSAADSLQGGSSLPPPLLKLQSTGYGSGWFPQGSRYVGGEEN

SEQ ID NO: 743419 - protein, 156 aa, Homo sapiens
GGKWRGEGGGRGGRGMYPQLNIPLFTLWLPRKAFFLWSTGVLRGQYTKFVEFTIKSTKVGLPYQFGESQGRIIIHLQVSVSSPSTAVESIPVFGALCSSSSLHQTLEALARDLTKLDLRRWASFMDAGVEHDDVAELLQELQSLAQCYQGGDSLVD

SEQ ID NO: 743420 - protein, 514 aa, Homo sapiens; identical to SEQ ID NO: 743406

SEQ ID NO: 743421 - protein, 180 aa, Homo sapiens
GAAEARRPRGAAQYGGRGPGGAHTAVGTFCRFRGRALVEPAGCCAGPSDRFQGAPGRAVPRRPVSYGPDAARPGDLHAATHPHGSEGYPHLFSSCSPPGMVLDGSPKGAAVESIPVFGALCSSSSLHQTLEALARDLTKLDLRRWASFMDAGVEHDDVAELLQELQSLAQCYQGGDSLVD

SEQ ID NO: 743422 - protein, 567 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAGLCFLSLHSSGEHPSVWGTVFLFVPAPDPGSLGQRPHQTRLAALGQLHGCWSGAR

SEQ ID NO: 743423 - protein, 433 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGFVLVLASCSPDL

SEQ ID NO: 743424 - protein, 365 aa, Homo sapiens; identical to SEQ ID NO: 743410

SEQ ID NO: 743425 - protein, 348 aa, Homo sapiens
ARLRRGGPVEQRSMAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEDCDSVKQKGGYAVWPANSRRTKQPLPLNCLEPNVDFSDPSQGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGGQRPHQTRLAALGQLHGCWSGAR

SEQ ID NO: 743426 - protein, 123 aa, Homo sapiens
RCKSWIMFTCGREAGRLEAFGQGESVLKEPKYQEELEDRLHFYVEECDYLQVVAWQCALQGGSSSHPANYLLSLTPVQGFQILCDLHDGFSGVGAKAAELLQDEYSGRGIITWGLLPGPYHRG

SEQ ID NO: 743427 - protein, 336 aa, Homo sapiens
SGRCHSTTKMAAPGSCALWSYCGRGWSRAMRGCQLLGLRSSWPGDLLSARLLSQEKRAAETHFGFETVSEEEKGGKVYQVFESVAKKYDVMNDMMSLGIHRVWKDLLLWKMHPLPGTQLLDVAGGTGDIAFRFLNYVQSQHQRKQKRQLRAQQNLSWEEIAKEYQNEEDSLGGSRVVVCDINKEMLKVGKQKALAQGYRAGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQEEFKDMIEDAGFHKVTYESLTSGIVAIHSGFKL

SEQ ID NO: 743428 - protein, 110 aa, Homo sapiens
MMSLGIHRVWKDLLLWKMHPLPGTQLLDVAGGTGDIAFRFLNYVQSQHQRKQKRQLRAQQNLSWEEIAKEYQNEEDSLGGSRVVVCDINKEMLKVGKQKALAQGYRAGLA

SEQ ID NO: 743429 - protein, 246 aa, Homo sapiens
MNDMMSLGIHRVWKDLLLWKMHPLPGTQLLDVAGGTGDIAFRFLNYVQSQHQRKQKRQLRAQQNLSWEEIAKEYQNEEDSLGGSRVVVCDINKEMLKVGKQKALAQGYRAGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQEEFKDMIEDAGFHKVTYESLTSGIVAIHSGFKL

SEQ ID NO: 743430 - protein, 219 aa, Homo sapiens
VPNSARGEARDIAFRFLNYVQSQHQRKQKRQLRAQQNLSWEEIAKEYQNEEDSLGGSRVVVCDINKEMLKVGKQKALAQGYRAGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQEEFKDMIEDAGFHKVTYESLTSGIVAIHSGFKL

SEQ ID NO: 743431 - protein, 318 aa, Homo sapiens
SGRCHSTTKMAAPGSCALWSYCGRGWSRAMRGCQLLGLRSSWPGDLLSARLLSQEKRAAETHFGFETVSEEEKGGKVYQVFESVAKKYDVMNDMMSLGIHRVWKDLLLWKMHPLPGTQLLDVAGGTGDIAFRFLNYVQSQHQRKQKRQLRAQLGGSRVVVCDINKEMLKVGKQKALAQGYRAGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQEEFKDMIEDAGFHKVTYESLTSGIVAIHSGFKL

SEQ ID NO: 743432 - protein, 228 aa, Homo sapiens
MNDMMSLGIHRVWKDLLLWKMHPLPGTQLLDVAGGTGDIAFRFLNYVQSQHQRKQKRQLRAQLGGSRVVVCDINKEMLKVGKQKALAQGYRAGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQEEFKDMIEDAGFHKVTYESLTSGIVAIHSGFKL

SEQ ID NO: 743433 - protein, 203 aa, Homo sapiens
SGRCHSTTKMAAPGSCALWSYCGRGWSRAMRGCQLLGLRSSWPGDLLSARLLSQEKRAAETHFGFETVSEEEKGGKVYQVFESVAKKYDVMNDMMSLGIHRVWKDLLLWKMHPLPGTQLLDVAGGTGDIAFRFLNYVQSQHQRKQKRQLRAQQNLSWEEIAKEYQNEEDSLGGSRVVVCDINKEMLKVGKQKALAQGYRAGLA

SEQ ID NO: 743434 - protein, 137 aa, Homo sapiens
SGRCHSTTKMAAPGSCALWSYCGRGWSRAMRGCQLLGLRSSWPGDLLSARLLSQEKRAAETHFGFETVSEEEKGGKVYQVFESVAKKYDVMNDMMSLGIHRVWKDLLLWKMHPLPGTQLLDVAGGTGNVEFGILHYH

SEQ ID NO: 743435 - protein, 106 aa, Homo sapiens
VTPLPTHRGGTGSQRGRCLIDTEHKWQELASDLSPSGVAVPLPRTRWSWREGGRGVCEVQMEMLGRPFPKVGGEVGLEPYWMLKCPAALLMKAGPHRSVYTLCVCI

SEQ ID NO: 743436 - protein, 101 aa, Homo sapiens
RKLPVMQNGKAVPGPSPQRVLASLNPTANRGSGLIPVTRVRAEVGLGPWPPGGASKLPLLQTLQARPLWVGLGKGPHLGLGTFYYNADRNRQLPHPALGLP

SEQ ID NO: 743437 - protein, 101 aa, Homo sapiens; identical to SEQ ID NO: 743436

SEQ ID NO: 743438 - protein, 122 aa, Homo sapiens
RSTKKRRRRGSKEGEEDQNPPCPRLSGVLMEVEEPEILQDSLDRCYSTPSMFFELPDSFQHYRSVFYSFEEQRVGWALDMDEMEKYQEVEEDQDPSCPRLSRELLDEKEPEVLRDSLDRCYS

SEQ ID NO: 743439 - protein, 104 aa, Homo sapiens
RSTKKRRRRGSKEGEEDQNPPCPRLSGVLMEVEEPEILQDSLDRCYSTPSMFFELPDSFQHYRSVFYSFEEQHISFALDVDNRFLTLMGTSLHLVFQMGVIFPQ

SEQ ID NO: 743440 - protein, 106 aa, Homo sapiens
LGVPLGLASLHHDDRKLARTDYGHGVLEVLFLCRRPVLCFFPSSPLSKPHSHKYTSLCAKTRICILYISVTLTHTCGVSIAFPPRVPVVLPSTQHPPKQAVAHYHS

SEQ ID NO: 743441 - protein, 89 aa, Homo sapiens
RFHPHETNPAVRSSQDRLEEQRKEVMLPVSKAWGHLEEAGITVQVEWKCNGRSGTTVKHVPEGQGGRFCCTNEVRAIKRAKEVLLIWIK

SEQ ID NO: 743442 - protein, 273 aa, Homo sapiens
VRSAPASNKHGSLKPLRLKSNMEVCTYIAPLRGRPYRGGVSSVQAGSPGDLRDSLQRQRKTDNGWIRVQILEEGVWDRDLEKSTRLEEDAMESEPLAGTKTRGRGRRRWEARHGWTLPAHASQPSPRTVVATATGAEVLARAGRSAGTRVAGPESQLSHLYGWDKYSNPRPSRRARAVARVHALEQVTYLVQGPEMGSDSVPAGNFTSDPVSALQLKTTRSTLAGVGLIGAIVQCREHTRTLRIVSCHKDPEQVDPAVMHKEDHARYDKDLHH

SEQ ID NO: 743443 - protein, 273 aa, Homo sapiens; identical to SEQ ID NO: 743442

SEQ ID NO: 743444 - protein, 506 aa, Homo sapiens
MAEADFKMVSEPVAHGVAEEEMASSTSDSGEESDSSSSSSSTSDSSSSSSTSGSSSGSGSSSSSSGSTSSRSRLYRKKRVPEPSRRARRAPLGTNFVDRLPQAVRNRVQALRNIQDECDKVDTLFLKAIHDLERKYAELNKPLYDRRFQIINAEYEPTEEECEWNSEDEEFSSDEEVQDNTPSEMPPLEGEEEENPKENPEVKAEEKEVPKEIPEVKDEEKEVPKEIPEVKAEEKADSKDCMEATPEVKEDPKEVPQVKADDKEQPKATEAKARAAVRETHKRVPEERLQDSVDLKRARKGKPKREDPKGIPDYWLIVLKNVDKLGPMIQKYDEPILKFLSDVSLKFSKPGQPVSYTFEFHFLPNPYFRNEVLVKTYIIKAKPDHNDPFFSWGWEIEDCKGCKIDWRRGKDVTVTTTQSRTTATGEIEIQPRVVPNASFFNFFSPPEIPMIGKLEPREDAILDEDFEIGQILHDNVILKSIYYYTGEVNGTYYQFGKHYGNKKYRK

SEQ ID NO: 743445 - protein, 506 aa, Homo sapiens; identical to SEQ ID NO: 743444

SEQ ID NO: 743446 - protein, 322 aa, Homo sapiens
MPPLEGEEEENPKENPEVKAEEKEVPKEIPEVKDEEKEVPKEIPEVKAEEKADSKDCMEATPEVKEDPKEVPQVKADDKEQPKATEAKARAAVRETHKRVPEERLQDSVDLKRARKGKPKREDPKGIPDYWLIVLKNVDKLGPMIQKYDEPILKFLSDVSLKFSKPGQPVSYTFEFHFLPNPYFRNEVLVKTYIIKAKPDHNDPFFSWGWEIEDCKGCKIDWRRGKDVTVTTTQSRTTATGEIEIQPRVVPNASFFNFFSPPEIPMIGKLEPREDAILDEDFEIGQILHDNVILKSIYYYTGEVNGTYYQFGKHYGNKKYRK

SEQ ID NO: 743447 - protein, 359 aa, Homo sapiens
MITGTSQADCAVLIVAAGVGEFEAGISKNGQTQEHALLAYTLGVKQLIVGVNKMDSTEPPYSQKRYEEIVKEVNTYIKKIGYNPDTEAFVPISGWNGDNMLEPSFNMPWFKGRKSSCKDGNTSGTMLLEALDYILPPTHPTTSPFACLSRMSTKIGGIGTVPVGRVETGVLKPGMVVTFAPVNIKTEVKSVEMHHEALSETLSGDNVGFNVKNVSVKDVRHGNDAGDSKDDPPMEAAGFTAQVIILNHPGQISAGYAPVLDCHTAHTACKFAELKERLIAFGKSWKMALNSESGDAAIVDMVPGKPMCVESFSDYPPLGRFAVRDMRQTVAVGVIKAVDKKAAGAGKVTKSAQKAQKAK

SEQ ID NO: 743448 - protein, 65 aa, Homo sapiens
MCPKVPLLQSSGSIFAFQIQNKNTKKRGIPIRTRNRMRILLRMGSRVFKYFNICHNKVLLLIERH

SEQ ID NO: 743449 - protein, 244 aa, Homo sapiens
MTVRPPQPCGTGAAEDPQTALALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 743450 - protein, 227 aa, Homo sapiens
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTALALNFGSTLMKKKSDPEGPALLFPESELSIRIDKSENGEAYQRKKAAATGLPEGPAVPVPSRGNLAQPGGSSWRRIALLILAITIHNVPVETRVLLCWPGWPRTAGLRRTSCFSLP

SEQ ID NO: 743451 - protein, 103 aa, Homo sapiens
MVISRPVGFRHGGCKMCLSLSAMTVRPPQPCGTGAAEDPQTALALNFGSTLMKKKSDPEGPALLFPESELSIRIGRAGLLSGKLFAADTELSQAIWTWGLVVG

SEQ ID NO: 743452 - protein, 230 aa, Homo sapiens
MWPLGSTHSQPCGTGAAEDPQTALALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQIRLENLPSLS

SEQ ID NO: 743453 - protein, 342 aa, Homo sapiens
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTALALNFGSTLMKKKSDPEGPALLFPESELSIRIGRAGLLSDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 743454 - protein, 249 aa, Homo sapiens
MYFWRDVVRPPQPCGTGAAEDPQTALALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 743455 - protein, 335 aa, Homo sapiens
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTALALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 743456 - protein, 103 aa, Homo sapiens; identical to SEQ ID NO: 743451

SEQ ID NO: 743457 - protein, 238 aa, Homo sapiens
VPFFPIRFILYANEFSIVERKQASGYRPAASQGLLEKDYRCFPVGFYKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 743458 - protein, 224 aa, Homo sapiens
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTALALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESAR

SEQ ID NO: 743459 - protein, 233 aa, Homo sapiens
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTALALNFGSTLMKKKSDPEGPALLFPESELSIRIDKSENGEAYQRKKAAATGLPEGPAVPVPSRGNLAQPGGSSWRRIALLILAITIHNVPDVFASPSAMIVSFLRPPQLCETRVSLLELDLGL

SEQ ID NO: 743460 - protein, 238 aa, Homo sapiens
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTALALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESARVLNLVSCPGLNLPS

SEQ ID NO: 743461 - protein, 128 aa, Homo sapiens
MTVRPPQPCGTGAAEDPQTALALNFGSTLMKKKSDPEGPALLFPESELSIRIGRAGLLSDKSENGEAYQRKKAAATGLPEGPAVPVPSRGNLAQPGGSSWRRIALLILAITIHNVPGEVLPVSVTATA

SEQ ID NO: 743462 - protein, 108 aa, Homo sapiens
FLAPTEVLASARDSHCVSTYSRQQPSCAFLVFQEFGHWNRDPEFPRGPGCQPSLARGRLLHLESFLVSAAQGQGHVTASSMWASFNKTVMCFCTAMLRYDVEWHASMC

SEQ ID NO: 743463 - protein, 186 aa, Homo sapiens
RRRARAGSATQITMYSFMGGGLFCAWVGTILLVVAMATDHWMQYRLSGSFAHQGLWRYCLGNKCYLQTDSIAYWNATRAFMILSALCAISGIIMGIMAFAHQPTFSRISRPFSAGIMFFSSTLFVVLALAIYTGVTVSFLGRRFGDWRFSWSYILGWVAVLMTFFAGIFYMCAYRVHECRRLSTPR

SEQ ID NO: 743464 - protein, 228 aa, Homo sapiens
RRRARAGSATQITMYSFMGGGLFCAWVGTILLVVAMATDHWMQYRLSGSFAHQGLWRYCLGNKCYLQTDSIGEPPGQGPGRAWGKSRADLGAQGHLYSRWRTLRLKEGKGATQAYWNATRAFMILSALCAISGIIMGIMAFAHQPTFSRISRPFSAGIMFFSSTLFVVLALAIYTGVTVSFLGRRFGDWRFSWSYILGWVAVLMTFFAGIFYMCAYRVHECRRLSTPR

SEQ ID NO: 743465 - protein, 120 aa, Homo sapiens
RRRARAGSATQITMYSFMGGGLFCAWVGTILLVVAMATDHWMQYRLSGSFAHQGLWRYCLGNKCYLQTDSIAYWNATRAFMILSALCAISGIIMGIMAFVGGSAHDVLRRDFLHVRLPGA

SEQ ID NO: 743466 - protein, 105 aa, Homo sapiens
AQIGSRCCGEKQYRAGRARWSCLQLGFGGFEAHIRGKWLCSCRFAQSGFLRFRGLGGFLWGCGGKRISSDNGPEQESLSRSRPDAGLPADTTDDFIGSESVSQRS

SEQ ID NO: 743467 - protein, 249 aa, Homo sapiens
MADPEVCCFITKILCAHGGRMALDALLQEIALSEPQLCEVLQVAGPDRFVVLETGGEAGITRSVVATTRARVCRRKYCQRPCDNLHLCKLNLLGRCNYSQSERNLCKYSHEVLSEENFKVLKNHELSGLNKEELAVLLLQSDPFFMPEICTSYKGEGRQQICTRSHESDPLRDPLTEGTRSNCLRPYWWRTLATQDQGTHVQPYSAAFKTRQTSRDGWCQRAPRTSERTTKHRAGTQRAPQGPGHRHIT

SEQ ID NO: 743468 - protein, 199 aa, Homo sapiens
IYGAQQACQAMGSLYHTDCFTCDSCGRRLRGKAFYNVGEKVYCQEDFLYSGFQQTADKCSVCGHLIMEMILQALGKSYHPGCFRCSVCNECLDGVPFTVDVENNIYCVRDYHTVFAPKCASCARPILPAQGCETTIRVVSMDRDYHVACYHCEDCGLQLSGEEGRRCYPLAGHLLCRRCHLRRLQPGPLPSPTVHVTEL

SEQ ID NO: 743469 - protein, 268 aa, Homo sapiens
MSQRVEERLLVFQLLQSSDGGLYRDSGSGIVRPGTASHCLHAGTTVPDPHSSSLHLGFATERASVLGVLADFNFLHHFPEGGPIAGPVFTDDPDFLGRWAMSPPTRPEKVYCQEDFLYSGFQQTADKCSVCGHLIMEMILQALGKSYHPGCFRCSVCNECLDGVPFTVDVENNIYCVRDYHTVFAPKCASCARPILPAQGCETTIRVVSMDRDYHVACYHCEDCGLQLSGEEGRRCYPLAGHLLCRRCHLRRLQPGPLPSPTVHVTEL

SEQ ID NO: 743470 - protein, 103 aa, Homo sapiens
WDYRHEPLHPVQEFNSLKIFTLFCSKFSYGKNTEFCPEGLCTSGSFSLAWTFFFFQRQTLILSPRLECSGVVTAHCSLELLDSSDPPSSPSQIAGITHMNHHS

SEQ ID NO: 743471 - protein, 67 aa, Homo sapiens
MAFEKLQSAADVKSMFQVPICALVFTEQSACPHIGTCGGVEIRTARTTVHNLQKYECPSFLLEPGKQ

SEQ ID NO: 743472 - protein, 422 aa, Homo sapiens
MSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 743473 - protein, 498 aa, Homo sapiens
MELLTFRDVTIEFSLEEWEFLNPAQQSLYRKVMLENYRNLVSLGLTVSKPELISRLEQRQEPWNVKRHETIAKPPAMSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 743474 - protein, 422 aa, Homo sapiens; identical to SEQ ID NO: 743472

SEQ ID NO: 743475 - protein, 70 aa, Homo sapiens
LNRALRSELTSVLAGEQAPGEPTCGEGGGRWPAQGSACFPDRRSQDHHFEPVEGPALELLVGAGRFHFVT

SEQ ID NO: 743476 - protein, 471 aa, Homo sapiens
HGRRPRAAPRPPPGADAASEEGARRMERVVVSMQDPDQGVKMRSQRLLVTVIPHAVTGSDVVQWLAQKFCVSEEEALHLGAVLVQHGYIYPLRDPRSLMLRPDETPYRFQTPYFWTSTLRPAAELDYAIYLAKKNIRKRGTLVDYEKDCYDRLHKKINHAWDLVLMQAREQLRAAKQRSKGDRLVIACQEQTYWLVNRPPPGAPDVLEQGPGRGSCAASRVLMTKSADFHKREIEYFRKALGRTRVKSSVCLEAYLSFCGQRGPHDPLVSGCLPSNPWISDNDAYWVMNAPTVAAPTKLRVERWGFSFRELLEDPVGRAHFMDFLGKEFSGENLSFWEACEELRYGAQAQVPTLVDAVYEQFLAPGAAHWVNIDSRTMEQTLEGLRQPHRYVLDDAQLHIYMLMKKDSYPRFLKSDMYKALLAEAGIPLEMKRRVFPFTWRPRHSSPSPALLPTPVEPTAACGPGGGDGVA

SEQ ID NO: 743477 - protein, 460 aa, Homo sapiens
HGRRPRAAPRPPPGADAASEEGARRMERVVVSMQDPDQGVKMRSQRLLVTVIPHAVTGSDVVQWLAQKFCVSEEEALHLGAVLVQHGYIYPLRDPRSLMLRPDETPYRFQVRLGGAAIYLAKKNIRKRGTLVDYEKDCYDRLHKKINHAWDLVLMQAREQLRAAKQRSKGDRLVIACQEQTYWLVNRPPPGAPDVLEQGPGRGSCAASRVLMTKSADFHKREIEYFRKALGRTRVKSSVCLEAYLSFCGQRGPHDPLVSGCLPSNPWISDNDAYWVMNAPTVAAPTKLRVERWGFSFRELLEDPVGRAHFMDFLGKEFSGENLSFWEACEELRYGAQAQVPTLVDAVYEQFLAPGAAHWVNIDSRTMEQTLEGLRQPHRYVLDDAQLHIYMLMKKDSYPRFLKSDMYKALLAEAGIPLEMKRRVFPFTWRPRHSSPSPALLPTPVEPTAACGPGGGDGVA

SEQ ID NO: 743478 - protein, 140 aa, Homo sapiens
SVSQHPLIGSTAVGSQCPFLPSEQGNNEETISSVDELKIPKDCDRYDDLCSYMSWKTRKDTQWPENNLADKDQVSVATSFDITDENIATKRSDHFDAARSYGQYWTQEDSSKQAETYLTSKYPDSFSDSSDTIDKNKIPK

SEQ ID NO: 743479 - protein, 108 aa, Homo sapiens
NSFIMVLKAAKSKITAPADSLPRESSLPGLQVALFLLCPHVALLWCAHTHRERSSSFSYKNTPPIMKAQPSWPHLTLITSQRPSLQIPAHWWGEELELQHVNFGGRQT

SEQ ID NO: 743480 - protein, 255 aa, Homo sapiens
SGGHLCAGPRFRQRRSGESAVGLPAMEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKTLP

SEQ ID NO: 743481 - protein, 417 aa, Homo sapiens
SGGHLCAGPRFRQRRSGESAVGLPAMEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 743482 - protein, 417 aa, Homo sapiens; identical to SEQ ID NO: 743481

SEQ ID NO: 743483 - protein, 417 aa, Homo sapiens; identical to SEQ ID NO: 743481

SEQ ID NO: 743484 - protein, 140 aa, Homo sapiens
RHIVSNVFCSFFPRYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 743485 - protein, 417 aa, Homo sapiens; identical to SEQ ID NO: 743481

SEQ ID NO: 743486 - protein, 294 aa, Homo sapiens
SGGHLCAGPRFRQRRSGESAVGLPAMEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKVITSHLTRTTAVNILTQRTLPPG

SEQ ID NO: 743487 - protein, 166 aa, Homo sapiens
KGRRFVFYPCLREGTARGCAFQSRLPPPPPAGPPGQTGDPAATPVAVSMPQPSCPPVPHEGDHRDKGAPGPLPPARATVKSRARSQAEEAASRTCGVRRRALGGLPAGGGGGQEKEATSLLEDKKTPIPERQAWGKQPQGTGGGQRPRERQGLVTQGTNEHLLNIY

SEQ ID NO: 743488 - protein, 120 aa, Homo sapiens
LTELVKPRKSPGLAAVFFQWHSEGFVFSVSVLFFGLCSISFLAFCNKLVVSQYFYVSGFTMSQLCDLGKFTSVFLCFLCCECGDGGLSSGVTILIFAKILEWCLARSEWAANIRCSDLRF

SEQ ID NO: 743489 - protein, 116 aa, Homo sapiens
MILSRNLPSNVVARLLAHQGSAACLPALPQVVAKALKIMSPPHRLGSFQVSWETVSSVPWQANFRAISSTGLWQVWCARKTPSLRHGQRVTGVYGGLHMKSSQFLPYSFSVSLKLL

SEQ ID NO: 743490 - protein, 171 aa, Homo sapiens
SGVPGSPASPRTLREVRASACAPGPGERMRKVESRGEGGREELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQVKE

SEQ ID NO: 743491 - protein, 796 aa, Homo sapiens
MNQTASVSHHIKCQPSKTIKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRPQNISILTVCETTTGACSKKYEMTSDTWLSQQNEEPVFSRDGSKFFMTVPVKQGGRGEFHHIAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 743492 - protein, 817 aa, Homo sapiens
SGVPGSPASPRTLREVRASACAPGPGERMRKVESRGEGGREELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRPQNISILTVCETTTGACSKKYEMTSDTWLSQQNEEPVFSRDGSKFFMTVPVKQGGRGEFHHIAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 743493 - protein, 796 aa, Homo sapiens; identical to SEQ ID NO: 743491

SEQ ID NO: 743494 - protein, 780 aa, Homo sapiens
MNQTASVSHHIKCQPSKTIKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRPQNISILTVCETTTGACSKKYEMTSDTWLSQQNEEPVFSRDGSKFFMTVPVKQGGRGEFHHIAMFLIQSKSEQITVRHLTSGNWEVIKILAYDETTQKIASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 743495 - protein, 492 aa, Homo sapiens
VLGRSGAWREGAGLRGREGARAGGNRTPPAPMAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 743496 - protein, 460 aa, Homo sapiens
ARGRAQRSLERRRWAARARGREGRGQPDPARTHGARRRLGRAGRRTGALGCGARLARPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 743497 - protein, 520 aa, Homo sapiens
VLGRSGAWREGAGLRGREGARAGGNRTPPAPMAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPDLSYGSSAKAQLSRRVSEWIDKFGLFPEGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 743498 - protein, 460 aa, Homo sapiens; identical to SEQ ID NO: 743496

SEQ ID NO: 743499 - protein, 170 aa, Homo sapiens
MQLGHIDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNFQVV

SEQ ID NO: 743500 - protein, 166 aa, Homo sapiens
MQLGHIDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDK

SEQ ID NO: 743501 - protein, 172 aa, Homo sapiens
GGRDQGCLDDGGGWWNISPPALSTCMSQVQPCPSSIISPQRRGRTLRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDK

SEQ ID NO: 743502 - protein, 302 aa, Homo sapiens
MILLNNSHKLLALYKSLARSIPESLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 743503 - protein, 152 aa, Homo sapiens
MILLNNSHKLLALYKSLARSIPESLKVYGSVYHINHGNPFNMEVLVDSWPEYQMVIIRPQKQQIDLIDLGFIAKRYYPYWFLPKGGFQKSGRKVLGATFVRIRKRGNTRRLPNPRSFRETVKRWKGHTDGGYNFSTVQVERLSHFEKHSLLW

SEQ ID NO: 743504 - protein, 302 aa, Homo sapiens; identical to SEQ ID NO: 743502

SEQ ID NO: 743505 - protein, 302 aa, Homo sapiens; identical to SEQ ID NO: 743502

SEQ ID NO: 743506 - protein, 302 aa, Homo sapiens; identical to SEQ ID NO: 743502

SEQ ID NO: 743507 - protein, 302 aa, Homo sapiens; identical to SEQ ID NO: 743502

SEQ ID NO: 743508 - protein, 302 aa, Homo sapiens; identical to SEQ ID NO: 743502

SEQ ID NO: 743509 - protein, 302 aa, Homo sapiens; identical to SEQ ID NO: 743502

SEQ ID NO: 743510 - protein, 261 aa, Homo sapiens
MEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 743511 - protein, 325 aa, Homo sapiens
MVSQEGSEVELLVSPGARSEHGRYLQDPIVSIDLSEWLRIIEFLLQGLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 743512 - protein, 270 aa, Homo sapiens
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 743513 - protein, 208 aa, Homo sapiens
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPML

SEQ ID NO: 743514 - protein, 223 aa, Homo sapiens
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPSCISHEIMERDMLFGCS

SEQ ID NO: 743515 - protein, 146 aa, Homo sapiens
MWLLVSVILISRISSVGGEVSAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 743516 - protein, 155 aa, Homo sapiens
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTIPVVSICSRFIS

SEQ ID NO: 743517 - protein, 205 aa, Homo sapiens
MWLLVSVILISRISSVGGEGLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 743518 - protein, 250 aa, Homo sapiens
MFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 743519 - protein, 155 aa, Homo sapiens; identical to SEQ ID NO: 743516

SEQ ID NO: 743520 - protein, 254 aa, Homo sapiens
MWLLVSVILISRISSVGGEAMFCDFPKINHGILYDEEKYKPFSQVPTGEVFYYSCEYNFVSPSKSFWTRITCAEEGWSPTPKCLRQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 743521 - protein, 211 aa, Homo sapiens
MWLLVSVILISRISSVGGEAMFCDFPKINHGILYDEEKYKPFSQVPTGEVFYYSCEYNFVSPSKSFWTRITCAEEGWSPTPKCLISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 743522 - protein, 91 aa, Homo sapiens
VLPCLVHEERKAQLREDICPRLHNWWVRGPGLTSGPPRCQPSLLLLSSASASSQPGTQKGPEPALMPAHDIFGTNPRISLISITGPKRRGR

SEQ ID NO: 743523 - protein, 1662 aa, Homo sapiens
ATDGASCEPDLSRAPEDAAGAAAEAAKKEFDVDTLSKSELRMLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQVGAWPAATPGLNQPACSDSSLVIPTTIAFCSSINPVSASSCRPGASDSLLVTASGWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLVEQYHNVIFHGPEGSLQDYIVHQLALCLKHRQMAAGFSCEIVRAEVDAGFSKEQLLDLFISSACLIPVKQSPSKKKIIIILENLEKSSLSELLRDFLAPLENRSTESPCTFQKGNGLSECYYFHENCFLMGTIAKACLQGSDLLVQQHFRWVQLRWDGEPMQGLLQRFLRRKVVNKFKGQAPSPCDPVCKIVDWALSVWRQLNSCLARLGTPEALLGPKYFLSCPVVPGHAQVTVKWMSKLWNGVIAPRVQEAILSRASVKRQPGFGQTTAKRHPSQGQQAVVKAALSILLNKAVLHGCPLPRAELDQHTADFKGGSFPLSIVSSYNTCNKKKGESGAWRKVNTSPRRKSGRFSLPTWNKPDLSTEGMKNKTISQLNCNRNASLSKQKSLENDLSLTLNLDQRLSLGSDDEADLVKELQSMCSSKSESDISKIADSRDDLRMFDSSGNNPVLSATINNLRMPVSQKEVSPLSSHQTTECSNSKSKTELGVSRVKSFLPVPRSKVTQCSQNTKRSSSSSNTRQIEINNNSKEVNWNLHKNEHLEKPNK

SEQ ID NO: 743524 - protein, 1591 aa, Homo sapiens
LLLTLPQVTLVPCAHGLLQERYGKVCGGNPMQREQQGQRPRGRTMFRKLRASSEAKGVSRIKVGDKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQVGAWPAATPGLNQPACSDSSLVIPTTIAFCSSINPVSASSCRPGASDSLLVTASGWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLVEQYHNVIFHGPEGSLQDYIVHQLALCLKHRQMAAGFSCEIVRAEVDAGFSKEQLLDLFISSACLIPVKQSPSKKKIIIILENLEKSSLSELLRDFLAPLENRSTESPCTFQKGNGLSECYYFHENCFLMGTIAKACLQGSDLLVQQHFRWVQLRWDGEPMQGLLQRFLRRKVVNKFKGQAPSPCDPVCKIVDWALSVWRQLNSCLARLGTPEALLGPKYFLSCPVVPGHAQVTVKWMSKLWNGVIAPRVQEAILSRASVKRQPGFGQTTAKRHPSQGQQAVVKAALSILLNKAVLHGCPLPRAELDQHTADFKGGSFPLSIVSSYNTCNKKKGESGAWRKVNTSPRRKSGRFSLPTWNKPDLSTEGMKNKTISQLNCNRNASLSKQKSLENDLSLTLNLDQRLSLGSDDEADLVKELQSMCSSKSESDISKIADSRDDLRMFDSSGNNPVLSATINNLRMPVSQKEVSPLSSHQTTECSNSKSKTELGVSRVKSFLPVPRSKVTQCSQNTKRSSSSSNTRQIEINNNSKEVNWNLHKNEHLEKPNK

SEQ ID NO: 743525 - protein, 1286 aa, Homo sapiens
LLLTLPQVTLVPCAHGLLQERYGKVCGGNPMQREQQGQRPRGRTMFRKLRASSEAKGVSRIKVGDKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQVGAWPAATPGLNQPACSDSSLVIPTTIAFCSSINPVSASSCRPGASDSLLVTASGWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLVEQYHNVIFHGPEGSLQDYIVHQLALCLKHRQMAAGFSCEIVRAEVDAGFSKEQLLDLFISSACLIPVKQSPSKKKIIIILENLEKSSLSELLRDFLAPLENRSTESPCTFQKGNGLSECYYFHENCFLMGTIAKACLQGSDLLVQQHFRWVQLRWDGEPMQGLLQRFLRRKVVNKFKGQAPSPCDPVCKIVDWALSVWRQLNSCLARLGTPEALLGPKYFLSCPVVPGHAQVTVKARPAYS

SEQ ID NO: 743526 - protein, 1052 aa, Homo sapiens
LLLTLPQVTLVPCAHGLLQERYGKVCGGNPMQREQQGQRPRGRTMFRKLRASSEAKGVSRIKVGDKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQVGAWPAATPGLNQPACSDSSLVIPTTIAFCSSINPVSASSCRPGASDSLLVTASGWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLMGKLNRER

SEQ ID NO: 743527 - protein, 143 aa, Homo sapiens
NLLATRKPLFKKTLGDSFKCRMLLESTLHPSCLYVKLHKRKTKLCGVKQPRHLFFRGRIIFQDTKAQITRYGTKMNTVKESNTHFQGPNPYPLKRNPLNWVGLLYGCLICCKFCSRTIIQACWVDKIKRHLTAAVLGSFENMC

SEQ ID NO: 743528 - protein, 119 aa, Homo sapiens
MRLLPRSRDNRGPLSRRPPFSPPPAARSCRPTPRRLRTSPPHFPLHLWRVRAVDAPALREEGLARILGTSWDAEIGSEPSPFCCPELGKLAVERLARGRQAENLLHLLGNCNRFVMHFR

SEQ ID NO: 743529 - protein, 150 aa, Homo sapiens
QSTSTSPLEPGTIQLSAHRGLYHDFWEEQVETGQTHHPDLVAAFHPGFHSSPDLMEAWLPTLLLLRDYKIPTLITVYSHQELVSSLQILVELDTHITAFGSNPFMSLKPEQVYSSPNKQPVYCSAYYIMFLGSSCQLDNRQLEEKVDGGI

SEQ ID NO: 743530 - protein, 42 aa, Homo sapiens
MPLIKAAGVNVEPFWPGLFAKALANVNIGSLICNVGAGGPAP

SEQ ID NO: 743531 - protein, 110 aa, Homo sapiens
SAAFVEWFFIDRLPRRGRVLLDPRWFGWWLLLPHSMCVSAPPWRAVLGVPSLLPTMCCPPALCAPLCFSPRLLWAGWCVLYVAAALCVPSVIISWPLSSLGGPSSVLQRT

SEQ ID NO: 743532 - protein, 573 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFGALWPGMKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 743533 - protein, 534 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFGALWPGMKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGMVSMLFLVTGLAIKLSTHEE

SEQ ID NO: 743534 - protein, 362 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFGALWPGMKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLET

SEQ ID NO: 743535 - protein, 316 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLET

SEQ ID NO: 743536 - protein, 304 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFGALWPGMKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELEV

SEQ ID NO: 743537 - protein, 304 aa, Homo sapiens; identical to SEQ ID NO: 743536

SEQ ID NO: 743538 - protein, 258 aa, Homo sapiens [sequence omitted]

SEQ ID NO: 743539 - protein, 1084 aa, Homo sapiens
ASFTGGRTNNAETVGKSPAYRRCSMNRSRAIVQRGRVLPPPAPLDTTNLAGRRTLQGRAKMASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFPDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 743540 - protein, 923 aa, Homo sapiens
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFPDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 743541 - protein, 923 aa, Homo sapiens; identical to SEQ ID NO: 743540

SEQ ID NO: 743542 - protein, 520 aa, Homo sapiens
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 743543 - protein, 246 aa, Homo sapiens
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTDGAHSSLRCCTVNASGGVSGAVTERLRGTNIICYSSVLDRAPRRQSC

SEQ ID NO: 743544 - protein, 941 aa, Homo sapiens
TPGMDPAVNPAFPPAAPAGYGGYQPHSGQDFAYGSRPQEPVPTATTMATYQDSYSYGQSAAARSYEDRPYFQSAALQSGRMTAADSGQPGTQEACGQPSPHGSHSHAQPPQQAPIVESGQPASTLSSGYTYPTATGVQPESSASIVTSYPPPSYNPTCTAYTAPSYPNYDASVYSAASPFYPPAQPPPPPGPPQQLPPPPAPAGSGSSPRADSKPPLPSKLPRPKAGPRQLQLHYCDICKISCAGPQTYREHLGGQKHRKKEAAQKTGVQPNGSPRGVQAQLHCDLCAVSCTGADAYAAHIRGSKHQKVFKLHAKLGKPIPTLEPALATESPPGAEAKPTSPTGPSVCASSRPALAKRPVASKALCEGPPEPQAAGCRPQWGKPAQPKLEGPGAPTQGGSKEAPAGCSDAQPVGPEYVEEVFSDEGRVLRFHCKLCECSFNDLNAKDLHVRGRRHRLQYRKKVNPDLPIATEPSSRARKVLEERMRKQRHLAEERLEQLRRWHAERRRLEEEPPQDVPPHAPPDWAQPLLMGRPESPASAPLQPGRRPASSDDRHVMCKHATIYPTEQELLAVQRAVSHAERALKLVSDTLAEEDRGRREEEGDKRSSVAPQTRVLKGVMRVGILAKGLLLRGDRNVRLALLCSEKPTHSLLRRIAQQLPRQLQMVTEDEYEVSSDPEANIVISSCEEPRMQVTISVTSPLMREDPSTDPGVEEPQADAGDVLSPKKCLESLAALRHARWFQARASGLQPCVIVIRVLRDLCRRVPTWGALPAWAMELLVEKAVSSAAGPLGPGDAVRRVLECVATGTLLTDGPGLQDPCERDQTDALEPMTLQEREDVTASAQHALRMLAFRQTHKVLGMDLLPPRHRLGARFRKRQRGPGEGEEGAGEKKRGRRRRRGARVSRLPPPPAGLCIPALLDVCAPTNGCFIPDVGQWSFPFE

SEQ ID NO: 743545 - protein, 314 aa, Homo sapiens
GRLSPVGSQRRPGRLPSASWPSADLTTNAGSWLMGSGSVEGVGAALGVGTLPSRGHSTAWWHRAHVGVDSVSTRHLRGPPGSLLSSLGFTLTTEPGAMPCGHVSPRKLTVCFSPEGSSQRPAAMRDRHQGPEGPLPACAHLGGPASLAMELLVEKAVSSAAGPLGPGDAVRRVLECVATGTLLTDGPGLQDPCERDQTDALEPMTLQEREDVTASAQHALRMLAFRQTHKVLGMDLLPPRHRLGARFRKRQRGPGEGEEGAGEKKRGRRRRRGARVSRLPPPPAGLCIPALLDVCAPTNGCFIPDVGQWSFPFE

SEQ ID NO: 743546 - protein, 634 aa, Homo sapiens
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEVGAPSSCSPPGGAAEPPDTCSCAPAAPAASAFGVSLGPG

SEQ ID NO: 743547 - protein, 634 aa, Homo sapiens; identical to SEQ ID NO: 743546

SEQ ID NO: 743548 - protein, 725 aa, Homo sapiens
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 743549 - protein, 676 aa, Homo sapiens
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 743550 - protein, 715 aa, Homo sapiens
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 743551 - protein, 359 aa, Homo sapiens
GSHVRSSLGPLGGPAGSSRSSPVPSLLQFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 743552 - protein, 725 aa, Homo sapiens; identical to SEQ ID NO: 743548

SEQ ID NO: 743553 - protein, 410 aa, Homo sapiens
SSVPGSTDVERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 743554 - protein, 315 aa, Homo sapiens
MTSLGLLCSLFLPLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 743555 - protein, 725 aa, Homo sapiens; identical to SEQ ID NO: 743548

SEQ ID NO: 743556 - protein, 229 aa, Homo sapiens [sequence omitted]

SEQ ID NO: 743557 - protein, 230 aa, Homo sapiens
EAYDPGTSHPSHFTGEETEAQKGELEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 743558 - protein, 217 aa, Homo sapiens
MLRGERWFLVMNLICVSLMASDGASSPVLGGSSHSSSHAHKTPGLWTLQDRRVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 743559 - protein, 396 aa, Homo sapiens
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHSSCCS

SEQ ID NO: 743560 - protein, 227 aa, Homo sapiens
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEW

SEQ ID NO: 743561 - protein, 112 aa, Homo sapiens
AEQTILKQNIFHFLFFKSLSVQDPAEADQGIHTSHTTPSPPAPGFRWGAEGTAWELHLGVAPEGAGPCLASTDSGLFLPYRKPLASLHLSPVSSALRMESGRGSSTPPGPIA

SEQ ID NO: 743562 - protein, 201 aa, Homo sapiens
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCRTLDGWEYAFEGTAGRFLTDSSIWIQCLEPAHVVEWNIILFSILITLSGLQVIICLIRVVMQLSKILCGSYSVIFQPGII

SEQ ID NO: 743563 - protein, 201 aa, Homo sapiens; identical to SEQ ID NO: 743562

SEQ ID NO: 743564 - protein, 201 aa, Homo sapiens; identical to SEQ ID NO: 743562

SEQ ID NO: 743565 - protein, 125 aa, Homo sapiens
MGSSLRVPRVFRLGLALACLGRASGLRASFLQGPAVGSTLVWQETHAGCTARGLDGVLTEWLPIVESQLSHEDTGPWWGQWNIILFSILITLSGLQVIICLIRVVMQLSKILCGSYSVIFQPGII

SEQ ID NO: 743566 - protein, 797 aa, Homo sapiens
MDCSAPKEMNKLPANSPEAAAAQGHPDGPCAPRTSPEQELPAAAAPPPPRVPRSASTGAQTFQSADARACEAERPGVGSCKLSSPRAQAASAALRDLREAQGAQASPPPGSSGPGNALHCKIPSLRGPEGDANVSVGKGTLERNNTPVVGWVNMSQSTVVLGTDGITSVLPGSVATVATQEDEQGDENKARGNWSSKLDFILSMVGYAVGLGNVWRFPYLAFQNGGGAFLIPYLMMLALAGLPIFFLEVSLGQFASQGPVSVWKAIPALQGCGIAMLIISVLIAIYYNVIICYTLFYLFASFVSVLPWGSCNNPWNTPECKDKTKLLLDSCVISDHPKIQIKNSTFCMTAYPNVTMVNFTSQANKTFVSGSEEYFKYFVLKISAGIEYPGEIRWPLALCLFLAWVIVYASLAKGIKTSGKVVYFTATFPYVVLVILLIRGVTLPGAGAGIWYFITPKWEKLTDATVWKDAATQIFFSLSAAWGGLITLSSYNKFHNNCYRDTLIVTCTNSATSIFAGFVIFSVIGFMANERKVNIENVADQGPGIAFVVYPEALTRLPLSPFWAIIFFLMLLTLGLDTMFATIETIVTSISDEFPKYLRTHKPVFTLGCCICFFIMGFPMITQGGIYMFQLVDTYAASYALVIIAIFELVGISYVYGLQRFCEDIEMMIGFQPNIFWKVCWAFVTPTILTFILCFSFYQWEPMTYGSYRYPNWSMVLGWLMLACSVIWIPIMFVIKMHLAPGRFIERLKLVCSPQPDWGPFLAQHRGERYKNMIDPLGTSSLGLKLPVKDLELGTQC

SEQ ID NO: 743567 - protein, 366 aa, Homo sapiens
MAELQQLQEFEIPTGREALRGNHSALLRVADYCEDNYVQATDKRKALEETMAFTTQALASVAYQVGNLAGHTLRMLDLQGAALRQVEARVSTLGQMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSASSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 743568 - protein, 366 aa, Homo sapiens; identical to SEQ ID NO: 743567

SEQ ID NO: 743569 - protein, 376 aa, Homo sapiens
CRLYWSEGLMMAELQQLQEFEIPTGREALRGNHSALLRVADYCEDNYVQATDKRKALEETMAFTTQALASVAYQVGNLAGHTLRMLDLQGAALRQVEARVSTLGQMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSASSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 743570 - protein, 373 aa, Homo sapiens
MAELQQLQEFEIPTGREALRGNHSALLRVADYCEDNYVQATDKRKALEETMAFTTQALASVAYQVGNLAGHTLRMLDLQGAALRQVEARVSTLGQMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSASSLASAGSAEGVGGAPTPKGQAAPPAPPLPSSLDPPPPPAAVEVFQRPPTLEELSPPPPAFLLFPQDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 743571 - protein, 370 aa, Homo sapiens
CRLYWSEGLMMAELQQLQEFEIPTGREALRGNHSALLRVADYCEDNYVQATDKRKALEETMAFTTQALASVAYQVGNLAGHTLRMLDLQGAALRQVEARMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSASSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 743572 - protein, 89 aa, Homo sapiens
RHGRFCWAVPGWAHETHGKVGGGFSGKMSPFTKGAPQRQGTLFCQTRATAFQPGEELTQQRPREGGRSPVAALTDPHKRGLRQQKWAGR

SEQ ID NO: 743573 - protein, 169 aa, Homo sapiens
MERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 743574 - protein, 120 aa, Homo sapiens
MERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKTVQRLPSPRALCHPHSSRA

SEQ ID NO: 743575 - protein, 198 aa, Homo sapiens [sequence omitted]

SEQ ID NO: 743576 - protein, 141 aa, Homo sapiens
MERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVEILSWGGCLEAGWGGTGRHGGEKGGF

SEQ ID NO: 743577 - protein, 104 aa, Homo sapiens
LGHCATLIPPELVEDHAPAPFGGGKTQIFCGHLTLSRPKSCLLVAVFPQRGSWDHASHFLPPGTVPKTGCPLLLRGLSRAPSGSEGECLCSFAQPAGPFVFEDA

SEQ ID NO: 743578 - protein, 308 aa, Homo sapiens
KRRQTSDVSLLGGHLILTLAPPSHASPPPSSPPTSQGRRARGGRLYESPPRPGVEEGSAASPWAPSLPLSPPCVVPGIARCCAAVSDSPSPIRLGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRIRETNLLMRKSHVPTGDRQPLPPQ

SEQ ID NO: 743579 - protein, 169 aa, Homo sapiens; identical to SEQ ID NO: 743573

SEQ ID NO: 743580 - protein, 169 aa, Homo sapiens; identical to SEQ ID NO: 743573

SEQ ID NO: 743581 - protein, 169 aa, Homo sapiens; identical to SEQ ID NO: 743573

SEQ ID NO: 743582 - protein, 169 aa, Homo sapiens; identical to SEQ ID NO: 743573

SEQ ID NO: 743583 - protein, 169 aa, Homo sapiens; identical to SEQ ID NO: 743573

SEQ ID NO: 743584 - protein, 169 aa, Homo sapiens; identical to SEQ ID NO: 743573

SEQ ID NO: 743585 - protein, 193 aa, Homo sapiens
MERFEVLGIPFSLQLWDTAGQERFKCIASTYYRGAQAIIIVFNLNDVASLEHTKQWLADALKENDPSSVLLFLVGSKKDLSVSVPVGGLPSLVRECPPLTLAFPQTPAQYALMEKDALQVAQEMKAEYWAVSSLTGENVREFFFRVAALTFEANVLAELEKSGARRIGDVVRINSDDSNLYLTASKKKPTCCP

SEQ ID NO: 743586 - protein, 169 aa, Homo sapiens; identical to SEQ ID NO: 743573

SEQ ID NO: 743587 - protein, 169 aa, Homo sapiens; identical to SEQ ID NO: 743573

SEQ ID NO: 743588 - protein, 161 aa, Homo sapiens
MERFEVLGIPFSLQLWDTAGQERFKCIASTYYRGAQAIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTASKKKPTCCP

SEQ ID NO: 743589 - protein, 169 aa, Homo sapiens; identical to SEQ ID NO: 743573

SEQ ID NO: 743590 - protein, 169 aa, Homo sapiens; identical to SEQ ID NO: 743573

SEQ ID NO: 743591 - protein, 237 aa, Homo sapiens
MERFEVLGIPFSLQLWDTAGQERFKCIASTYYRGAQAIIIVFNLNDVASLEHTKQWLADALKENDPSSVLLFLVGSKKDLSVSVPVGGLPSLVRECPPLTLAFPQTPAQYALMEKDALQVAQEMKAEYWAVSSLTGELEALGLCCDTLAWLSSHCYTSSCALCPQTQQLPLSTYLLSVSGENVREFFFRVAALTFEANVLAELEKSGARRIGDVVRINSDDSNLYLTASKKKPTCCP

SEQ ID NO: 743592 - protein, 281 aa, Homo sapiens
MVGQPQPRDDVGSPRPRVIVGTIRPRVIVGTIRPRVIVGSARARPPPDGTPRPQLAAEESPRPRVIFGTPRARVILGSPRPRVIVSSPWPAVVVASPRPRTPVGSPWPRVVVGTPRPRVIVGSPRARVADADPASAPSQGALQGRRQDEHSGTRAEGSRPGGAAPVPEEGGRFARAQRLPPPRHLRLPGAPDRHRGDLRSPRSLWWGTCRWGRLASLIGSAKTPLIRITRPPLEWTSRWNDLRCWAFPSVCSFGIPLGRRGSNALHQPTIEELKPSSLSST

SEQ ID NO: 743593 - protein, 153 aa, Homo sapiens
MERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRECLPG

SEQ ID NO: 743594 - protein, 376 aa, Homo sapiens
MVGQPQPRDDVGSPRPRVIVGTIRPRVIVGTIRPRVIVGSARARPPPDGTPRPQLAAEESPRPRVIFGTPRARVILGSPRPRVIVSSPWPAVVVASPRPRTPVGSPWPRVVVGTPRPRVIVGSPRARVADADPASAPSQGALQGRRQDEHSGTRAEGSRPGGAAPGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 743595 - protein, 169 aa, Homo sapiens; identical to SEQ ID NO: 743573

SEQ ID NO: 743596 - protein, 237 aa, Homo sapiens
MNILAPVRRDRVLAELPQCLRKEAALHGHKDFHPRVTCACQEHRTGTVGFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 743597 - protein, 170 aa, Homo sapiens
MERFEVLGIPFSLQLWDTAGQERFKCIASTYYRGAQAIIIVFNLNDVASLEHTKQWLADALKENDPSSVLLFLVGSKKDLSVSVPVGGLPSLVRECPPLTLAFPQTPAQYALMEKDALQVAQEMKAEYWAVSSLTGELEALGLCCDTLAWLSSHCYTSSCALCPQTQHCP

SEQ ID NO: 743598 - protein, 273 aa, Homo sapiens
MVGQPQPRDDVGSPRPRVIVGTIRPRVIVGTIRPRVIVGSARARPPPDGTPRPQLAAEESPRPRVIFGTPRARVILGSPRPRVIVSSPWPAVVVASPRPRTPVGSPWPRVVVGTPRPRVIVGSPRARVADADPASAPSQGALQGRRQDEHSGTRAEGSRPGGAAPVPEEGGRFARAQRLPPPRHLRLPGAPDRHRGDLRSPRSLWWGTCRWGRLASLIGSAKTPLIRITRPPLEWTSRWNDLRCWAFPSVCSYPCSVCADGERRPPGGPGDEG

SEQ ID NO: 743599 - protein, 368 aa, Homo sapiens
MVGQPQPRDDVGSPRPRVIVGTIRPRVIVGTIRPRVIVGSARARPPPDGTPRPQLAAEESPRPRVIFGTPRARVILGSPRPRVIVSSPWPAVVVASPRPRTPVGSPWPRVVVGTPRPRVIVGSPRARVADADPASAPSQGALQGRRQDEHSGTRAEGSRPGGAAPGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTASKKKPTCCP

SEQ ID NO: 743600 - protein, 179 aa, Homo sapiens
MERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGEMVPESLRVELDLRAGWLLGNGPPGIGPSRVRPFLGNLVRGGNTAGGPPQRVFTPGRGFPRHPGVVY

SEQ ID NO: 743601 - protein, 122 aa, Homo sapiens
MHLLSSQQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 743602 - protein, 130 aa, Homo sapiens
MGAQRPIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTASKKKPTCCP

SEQ ID NO: 743603 - protein, 226 aa, Homo sapiens [sequence omitted]

SEQ ID NO: 743604 - protein, 487 aa, Homo sapiens
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVAGLISPWNLPLYLLTWKIAPAMAAGNTVIAKPSELTSVTAWMLCKLLDKAGVPPGVVNIVFGTGPRVGEALVSHPEVPLISFTGSQPTAERITQLSAPHCKKLSLELGGKNPAIIFEDANLDECIPATVRSSFANQGEICLCTSRIFVQKSIYSEFLKRFVEATRKWKVGIPSDPLVSIGALISKAHLEKVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 743605 - protein, 394 aa, Homo sapiens
SPICSSKIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVAGLISPWNLPLYLLTWKIAPAMAAGNTVIAKPSELTSVTAWMLCKLLDKAGVPPGVVNIVFGTGPRVGEALVSHPEVPLISFTGSQPTAERITQLSAPHCKKLSLELGGKNPAIIFEDANLDECIPATVRSSFANQVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 743606 - protein, 419 aa, Homo sapiens
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVAGLISPWNLPLYLLTWKIAPAMAAGNTVIAKPSELTSVTAWMLCKLLDKAGVPPGVVNIVFGTGPRVGEALVSHPEVPLISFTGSQPTAERITQLSAPHCKKLSLELGGKNPAIIFEDANLDECIPATVRSSFANQGEICLCTSRIFVQKSIYSEFLKRFVEATRKWKVGIPSDPLVSIGALISKAHLEKVSKFLPCKLQNKFLFEEKLSTGIAQSDSEILLVTTPFLKNYNLGEIVDTESKHCGYEYANAVPVKVHPHEINELEKSAWRYH

SEQ ID NO: 743607 - protein, 473 aa, Homo sapiens
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVAGLISPWNLPLYLLTWKIAPAMAAGNTVIAKPSELTSVTAWMLCKLLDKAGVPPGVVNIVFGTGPRVGEALVSHPEVPLISFTGSQPTAERITQLSAPHCKKLSLELGGKNPAIIFEDANLDECIPATVRSSFANQGEICLCTSRIFVQKSIYSEFLKRFVEATRKWKVGIPSDPLVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 743608 - protein, 167 aa, Homo sapiens
MRETCPHQPANERQSIYVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 743609 - protein, 166 aa, Homo sapiens
LYYLSSLFTCVLICLSHKTMCSTWWELCLIYHCTPLPRPVPDTWQVLKSAGCSIHEGECPQPYPCSHSWQGEICLCTSRIFVQKSIYSEFLKRFVEATRKWKVGIPSDPLVSIGALISKAHLEKVSKFLPCKLQNKFLFEEKLSTGIAQSDSEILLVTTPFLKNYN

SEQ ID NO: 743610 - protein, 64 aa, Homo sapiens
MEKNKQGLLVNFGGGRGGGFGGNDNFGRGGNFSGRGGFGGSRGGGGYGGSGDGYNGFGNDGTGI

SEQ ID NO: 743611 - protein, 92 aa, Homo sapiens
AGFAPVHRAVFLSWGIWVCGVWGGEKEQGGREGMRTTLSMGQALGPAHTPSPASRVLTVLGHPPPHPTATAQSGARKPPRRSRILRLQPHPQ

SEQ ID NO: 743612 - protein, 108 aa, Homo sapiens
MLEGMDTPFSVMCLFHIACLYSNISCTPCIYTPTTYPQKLKQSTAVCAALHFHVLGLLSCLKSLSSAQEWHGPHRTSSLPPLPRANLDRNTATQLLSHAPMPEAADDG

SEQ ID NO: 743613 - protein, 130 aa, Homo sapiens
PRQEYSDTIIAQCSLGLLGSSGLLASAPRVARPEATVCYARLIVIIISSNSSRDWILPCCPGWFLAILPRLVSNSWPKAILLSLPKCRDYRCEPPCLASVIVYNWSPTGERRDDNGFFSPKTNERYQATV

SEQ ID NO: 743614 - protein, 71 aa, Homo sapiens
EHQGCGRHQKLEEARTASPLTPSEKAQPGHHLHLRFLASRTERMNVYCLSCQYVALCYSSPSKLTFSMSEG

SEQ ID NO: 743615 - protein, 37 aa, Homo sapiens
ARSTACRKTLGKQTLRRKYSFCGPLGKPSDFFREGNP

SEQ ID NO: 743616 - protein, 138 aa, Homo sapiens
LDFGHYVSHKNRIQIAKPTVDTKPPVAHTNHILKLSKLQGEQKKINKIEYENKQLCQKIANAHRGPAKVDCWNEYFSKSLNRETRNRELVRITMENQGILKRLVDRKPHYDRRASEIDWQNSRRYIRNTTRYLLSQNE

SEQ ID NO: 743617 - protein, 101 aa, Homo sapiens
FLDEGHIPVKLRHFASQCSSLSPRIQLLRSYWEAADHQFQGSQHGSALRSWPPGPILLPHRDRPGSLSLQHVGMYMLLSPHRLREQAGVRGSTRTANRTGA

SEQ ID NO: 743618 - protein, 114 aa, Homo sapiens
FLDEGHIPVKLRHFASQCSSLSPRIQLLRSYWEAADHQFQEDGLKIREAESLPQSNTADFKCLHSASLQQAPGGILMGPASSPWTLAVEGEKRTSAPPLRESLMPTKGLGWWTQ

SEQ ID NO: 743619 - protein, 266 aa, Homo sapiens [sequence omitted]

SEQ ID NO: 743620 - protein, 266 aa, Homo sapiens [sequence omitted]

SEQ ID NO: 743621 - protein, 266 aa, Homo sapiens [sequence omitted]

SEQ ID NO: 743622 - protein, 178 aa, Homo sapiens
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHGIVGFTRSAAPTIDCQWIDNTH

SEQ ID NO: 743623 - protein, 145 aa, Homo sapiens
MSKQNGGEGGIIINMSSLAGLMPVAQQPVYCASKHGIVGFTRSAALAANLMNSGVRLNAICPGFVNTAILESIEKEENMGQYIEYKDHIKDMIKYYGILDPPLIANGLITLIEDDALNGAIMKITTSKGIHFQDYDTTPFQAKTQ

SEQ ID NO: 743624 - protein, 198 aa, Homo sapiens
MHVNGKVALVTGAAQGIGRAFAEALLLKGAKVALVDWNLEAGVQCKAALDEQFEPQKTLFIQCDVADQQQLRGLMPVAQQPVYCASKHGIVGFTRSAALAANLMNSGVRLNAICPGFVNTAILESIEKEENMGQYIEYKDHIKDMIKYYGILDPPLIANGLITLIEDDALNGAIMKITTSKGIHFQDYDTTPFQAKTQ

SEQ ID NO: 743625 - protein, 266 aa, Homo sapiens [sequence omitted]

SEQ ID NO: 743626 - protein, 266 aa, Homo sapiens [sequence omitted]

SEQ ID NO: 743627 - protein, 158 aa, Homo sapiens
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHAT

SEQ ID NO: 743628 - protein, 192 aa, Homo sapiens
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHGIVGFTRSAALAANLMNSGVRLNAICPGFVNPSATR

SEQ ID NO: 743629 - protein, 266 aa, Homo sapiens [sequence omitted]

SEQ ID NO: 743630 - protein, 288 aa, Homo sapiens
WRFSGRFRACSSPTARPSSGCTMHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHGIVGFTRSAALAANLMNSGVRLNAICPGFVNTAILESIEKEENMGQYIEYKDHIKDMIKYYGILDPPLIANGLITLIEDDALNGAIMKITTSKGIHFQDYDTTPFQAKTQ

SEQ ID NO: 743631 - protein, 280 aa, Homo sapiens
MASRGPGYRPSGCTMHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHGIVGFTRSAALAANLMNSGVRLNAICPGFVNTAILESIEKEENMGQYIEYKDHIKDMIKYYGILDPPLIANGLITLIEDDALNGAIMKITTSKGIHFQDYDTTPFQAKTQ

SEQ ID NO: 743632 - protein, 124 aa, Homo sapiens
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYRFL

SEQ ID NO: 743633 - protein, 143 aa, Homo sapiens
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAAHH

SEQ ID NO: 743634 - protein, 266 aa, Homo sapiens [sequence omitted]

SEQ ID NO: 743635 - protein, 213 aa, Homo sapiens
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHGIVGFTRSAALAANLMNSGVRLNAICPGFVNTAILESIEKEENMGPTIDCQWIDNTH

SEQ ID NO: 743636 - protein, 975 aa, Homo sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSTNFHEEIQSLMQQTLMSSTVKR

SEQ ID NO: 743637 - protein, 1140 aa, Homo sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 743638 - protein, 313 aa, Homo sapiens
AVTSGICGPGEEIGGGERLSRLSFARFCGLFERPGVGQTRFLGNQESREGRMASFGWKRKIGEKVSKVTSQQFEAEAADEKDVVDNDEGNWLHAIKRRKEILLEGCAEKSKQLKDEGASLAENKRYREAIQKWDEALQLTPNDATLYEMKSQVLMSLHEMFPAVHAAEMAVQQNPHSWESWQTLGRAQLGLGEIILAIRSFQVALHIYPMNPEIWKEDLSWARTLQEQQKVAQRIKKSEAPAEVTHFSPKSIPDYDFESDEIVAVCAAIAEKEKTVSANKTMVIVSASGAIETVTEKEDGATPPDGSVFIKAR

SEQ ID NO: 743639 - protein, 269 aa, Homo sapiens
AVTSGICGPGEEIGGGERLSRLSFARFCGLFERPGVGQTRFLGNQESREGRMASFGWKRKIGEKVSKVTSQQFEAEAADEKDVVDNDEGNWLHAIKRRKEILLEGCAEKSKQLKDEGASLAENKRYREAIQKWDEALQLTPNDATLYEMKSQAIRSFQVALHIYPMNPEIWKEDLSWARTLQEQQKVAQRIKKSEAPAEVTHFSPKSIPDYDFESDEIVAVCAAIAEKEKTVSANKTMVIVSASGAIETVTEKEDGATPPDGSVFIKAR

SEQ ID NO: 743640 - protein, 131 aa, Homo sapiens
AVTSGICGPGEEIGGGERLSRLSFARFCGLFERPGVGQTRFLGNQESREGRMASFGWKRKIGEKVSKVTSQQFEAEAADEKDVVDNDEGNWLHAIKRRKEILLEGCAEKSKQLKDEGASLAENKRQFEVFK

SEQ ID NO: 743641 - protein, 140 aa, Homo sapiens
AVTSGICGPGEEIGGGERLSRLSFARFCGLFERPGVGQTRFLGNQESREGRMASFGWKRKIGEKVSKVTSQQFEAEAADEKDVVDNDEGNWLHAIKRRKEILLEGCAEKSKQLKDEGASLAENKRYVFKDFFLWRRAYIF

SEQ ID NO: 743642 - protein, 145 aa, Homo sapiens
MAAVFLVTLYEYSPLFYIAVVFTCFIVTTGLVLGWFGWDVPVILRNSEETQFSTRVFKKQMRQVKNPFGLEITNPSSASITTGITLTTDCLEDSLLTCYWGCSVQKLYEALQKHVYCFRISTPQALEDALYSEYLYQEQYLYPFV

SEQ ID NO: 743643 - protein, 332 aa, Homo sapiens
MAAVFLVTLYEYSPLFYIAVVFTCFIVTTGLVLGWFGWDVPVILRNSEETQFSTRVFKKQMRQVKNPFGLEITNPSSASITTGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 743644 - protein, 332 aa, Homo sapiens; identical to SEQ ID NO: 743643

SEQ ID NO: 743645 - protein, 363 aa, Homo sapiens
MAAVFLVTLYEYSPLFYIAVVFTCFIVTTGLVLGCRDGVSSCWPGWSRSLDLMIARDDLPKCWDYRFGWDVPVILRNSEETQFSTRVFKKQMRQVKNPFGLEITNPSSASITTGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 743646 - protein, 204 aa, Homo sapiens
MVIVAIYLYIFKNIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 743647 - protein, 263 aa, Homo sapiens
MAAVFLVTLYEYSPLFYIAVVFTCFIVTTGLVLGWFGWDVPVILRNSEETQFSTRVFKKQMRQVKNPFGLEITNPSSASITTGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKKKKTQTEVCWKRWDSLKVKLSHRKRTARTVLFARMGL

SEQ ID NO: 743648 - protein, 332 aa, Homo sapiens; identical to SEQ ID NO: 743643

SEQ ID NO: 743649 - protein, 332 aa, Homo sapiens; identical to SEQ ID NO: 743643

SEQ ID NO: 743650 - protein, 272 aa, Homo sapiens
MRQVKNPFGLEITNPSSASITTGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 743651 - protein, 365 aa, Homo sapiens
MAAVFLVTLYEYSPLFYIAVVFTCFIVTTGLVLGWFGWDVPVILRNSEETQFSTRVFKKQMRQVKNPFGLEITNPSSASITRSHSVIQVEMSGVIMADCSRDPPTSAFQEVRTTAGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 743652 - protein, 140 aa, Homo sapiens
MVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 743653 - protein, 928 aa, Homo sapiens
MLKSKTFLKKTRAGGVMKIVREHYLRDDIGCGAPGCAACGGAHEGPALEPQPQDPASSVCPQPHYLLPDTNVLLHQIVSAWRPGTWASVASSLRLPGSLETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEERERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 743654 - protein, 236 aa, Homo sapiens
MVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFLGKGNQPRFLMGKPIKKKVRLED

SEQ ID NO: 743655 - protein, 958 aa, Homo sapiens [sequence omitted]

SEQ ID NO: 743656 - protein, 958 aa, Homo sapiens [sequence omitted]

SEQ ID NO: 743657 - protein, 981 aa, Homo sapiens
MLKSKTFLKKTRAGGVMKIVREHYLRDDIGCGAPGCAACGGAHEGPALEPQPQDPASSVCPQPHYLLPDTNVLLHQIVSAWRPGTWASVASSLRLPGSIIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEERERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 743658 - protein, 1009 aa, Homo sapiens
RNLRELHKTDRLGGACRIDENRPVRRARTENMGQGREKTRQDREEDSWRGKMLKSKTFLKKTRAGGVMKIVREHYLRDDIGCGAPGCAACGGAHEGPALEPQPQDPASSVCPQPHYLLPDTNVLLHQIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEERERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 743659 - protein, 504 aa, Homo sapiens
MPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 743660 - protein, 958 aa, Homo sapiens [sequence omitted]

SEQ ID NO: 743661 - protein, 958 aa, Homo sapiens [sequence omitted]

SEQ ID NO: 743662 - protein, 844 aa, Homo sapiens
MLKSKTFLKKTRAGGVMKIVREHYLRDDIGCGAPGCAACGGAHEGPALEPQPQDPASSVCPQPHYLLPDTNVLLHQIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEERERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKE

SEQ ID NO: 743663 - protein, 897 aa, Homo sapiens
MLKSKTFLKKTRAGGVMKIVREHYLRDDIGCGAPGCAACGGAHEGPALEPQPQDPASSVCPQPHYLLPDTNVLLHQIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEERERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFLGKGNQPRFLMGKPIKKKVRLED

SEQ ID NO: 743664 - protein, 513 aa, Homo sapiens
MLKSKTFLKKTRAGGVMKIVREHYLRDDIGCGAPGCAACGGAHEGPALEPQPQDPASSVCPQPHYLLPDTNVLLHQIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEERERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFY

SEQ ID NO: 743665 - protein, 246 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSDGP

SEQ ID NO: 743666 - protein, 174 aa, Homo sapiens
TARYEAGFGKQHLESEKLLLYDTLQGELQERIQRLEEDRQSLDLSSEWWDDKLHARGSSRSWDSLPPSKRKKAPLVSGPYIVYMLQEIDILEDWTAIKKVGAAAAHVTCPTSGPPTLAAALPSAGLGVLCSPRLPHLQPRVPGSQLAHKSSCSRRPWEKGFLVCVSPFPFWGRF

SEQ ID NO: 743667 - protein, 246 aa, Homo sapiens; identical to SEQ ID NO: 743665

SEQ ID NO: 743668 - protein, 246 aa, Homo sapiens; identical to SEQ ID NO: 743665

SEQ ID NO: 743669 - protein, 246 aa, Homo sapiens; identical to SEQ ID NO: 743665

SEQ ID NO: 743670 - protein, 246 aa, Homo sapiens; identical to SEQ ID NO: 743665

SEQ ID NO: 743671 - protein, 290 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSDDRRTHRPLRVCPARLLWCCWALPLHLALAWTPPLPSSRPAQLWPWS

SEQ ID NO: 743672 - protein, 237 aa, Homo sapiens
VIYRILMDPPAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSDGP

SEQ ID NO: 743673 - protein, 304 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKDLDPAVHSQGDPQSSWHCTQDSRLPPADRRTHRPLRVCPARLLWCCWALPLHLALAWTPPLPSSRPAQLWPWS

SEQ ID NO: 743674 - protein, 306 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKVGAAAAHVTCPTSGPPTLAAALPSAGLGVLCSPRLPHLQPRVPGSQLAHKSSCSRRPWEKGFLVCVSPFPFWGRF

SEQ ID NO: 743675 - protein, 133 aa, Homo sapiens
MRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSDGP

SEQ ID NO: 743676 - protein, 70 aa, Homo sapiens
TDRLCLPKKREPRSAYGSPAAAAGTGNHGQLSGNLRREARGSSPRESRCLSSLQAKTQKRWKQRVILLLR

SEQ ID NO: 743677 - protein, 180 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSGP

SEQ ID NO: 743678 - protein, 156 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGPYIVYMLQEIDILEDWTAIKKARAAVSPQKRKSDGP

SEQ ID NO: 743679 - protein, 154 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLECAGTLSQT

SEQ ID NO: 743680 - protein, 70 aa, Homo sapiens; identical to SEQ ID NO: 743676

SEQ ID NO: 743681 - protein, 124 aa, Homo sapiens
APTHKHVCTHTAPSHKYTCTQPLHTSTHAYAHTAPTHKHTRTHTAPSHKHVRAHTHRPYTQACMHTHTCRTHMHTCGYPPLLPRASPYWPLVPEMDDEDYERRRSECVSEMLDLEKQFSELKEK

SEQ ID NO: 743682 - protein, 120 aa, Homo sapiens
DTALHTPERRSPGQMTLQAPADTALHTPGRRSPAQMTLQAPADTALHTPGRRSPGKMTPDTSRYSIAHTRTRKPRADDSPGTSRYSTAHTRTQKPRADDSPGTSRYSTAHTRMRKPRADD

SEQ ID NO: 743683 - protein, 347 aa, Homo sapiens [sequence omitted]

SEQ ID NO: 743684 - protein, 237 aa, Homo sapiens [sequence omitted]

SEQ ID NO: 743685 - protein, 431 aa, Homo sapiens
VPTSLHFQSMLKSQWQNKPFDKIKPPKKLSLKHRAPMPGSLPDSARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 743686 - protein, 104 aa, Homo sapiens
SSDGRTTPQLGSANPSTPQPASPDVSSSHSLSEYSHGQSPRSPISPELHSAPLTPVARDTPRHLASEDTRCSTPELGLDEQVRDAAFGWGWHGWGMEPGRGSIC

SEQ ID NO: 743687 - protein, 431 aa, Homo sapiens; identical to SEQ ID NO: 743685

SEQ ID NO: 743688 - protein, 431 aa, Homo sapiens; identical to SEQ ID NO: 743685

SEQ ID NO: 743689 - protein, 272 aa, Homo sapiens
VPTSLHFQSMLKSQWQNKPFDKIKPPKKLSLKHRAPMPGSLPDSARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQQPVRRRRGESSFDINNIVIPMSVAATTRVEKLQYKEILTPSWREVDLQSLKGSPDEENEEIEDLSDAAFAALHAKCEEMERARWLWTTSVPPQRRGSR

SEQ ID NO: 743690 - protein, 67 aa, Homo sapiens
RGSRQSQPDPAAGTPAARAFRALGASDAGALPATPGRFLNLTTSREAKGRVDLERSKFRIFKITFFS

SEQ ID NO: 743691 - protein, 460 aa, Homo sapiens
MASREEVLALQAEVAQREEELNSLKQKLASALLAEQEPQPERLVPVSPLPPKAALSRDEILRYSRQLVLPELGVHGQLRLGTACVLIVGCGGLGCPLAQYLAAAGVGRLGLVDYDVVEMSNLARQVLHGEALAGQAKAFSAAASLRRLNSAVECVPYTQALTPATALDLVRRYDVVADCSDNVPTRYLVNDACVLAGRPLVSASALRFEGQITVYHYDGGPCYRCIFPQPPPAETVTNCADGGVLGVVTGVLGCLQALEVLKIAAGLGPSYSGSLLLFDALRGHFRSIRLRSRRLDCAACGERPTVTDLLDYEAFCGSSATDKCRSLQLLSPEERVSVTDYKRLLDSGAFHLLLDVRPQVEVDICRLPHALHIPLKHLERRDAESLKLLKEAIWEEKQGTQEGAAVPIYVICKLGNDSQKAVKILQSLSAAQELDPLTVRDVVGGLMAWAAKIDGTFPQY

SEQ ID NO: 743692 - protein, 460 aa, Homo sapiens; identical to SEQ ID NO: 743691

SEQ ID NO: 743693 - protein, 601 aa, Homo sapiens
EAGERDAAGAGSGARGLLPAPLPGRRLLEPQERAARTPRRRPLFRQRYDLSLDEMRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMGYMMENRISGLKCDTDVFATFEGDDVVMLQVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVTLEQFSLAVKSCPDQEDQTLLMKFCLLYGTKLVFQERAWYLEHKYLTPMASTRIRNQERC

SEQ ID NO: 743694 - protein, 468 aa, Homo sapiens
EAGERDAAGAGSGARGLLPAPLPGRRLLEPQERAARTPRRRPLFRQRYDLSLDEMRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMGYMMENRISGLKCDTDVFATFEGDDVVMLQGCGGRGNWLGPNPKTSEKKPLLWAWLQKTGA

SEQ ID NO: 743695 - protein, 513 aa, Homo sapiens
EAGERDAAGAGSGARGLLPAPLPGRRLLEPQERAARTPRRRPLFRQRYDLSLDEMRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMGYMMENRISGLKCDTDVFATFEGDDVVMLQVVGRELLAQYTKQYEEKPLFGLLQNWAESVGDKLRTSFLAFNMDTVDDLAFLLKAVKFRERVLQRGLVARIYYKLP

SEQ ID NO: 743696 - protein, 560 aa, Homo sapiens
EAGERDAAGAGSGARGLLPAPLPGRRLLEPQERAARTPRRRPLFRQRYDLSLDEMRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMGYMMENRISGLKCDTDVFATFEGDDVVMLQVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVLSVVWNQAGVSGAGLVFRT

SEQ ID NO: 743697 - protein, 189 aa, Homo sapiens
EAGERDAAGAGSGARGLLPAPLPGRRLLEPQERAARTPRRRPLFRQRYDLSLDEMRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQMGKQRLTEVKQLTLAMQLMT

SEQ ID NO: 743698 - protein, 147 aa, Homo sapiens
QARKWKFEMSYTSSYCRGVQCACFSKDDKYVYVGLKDRSILVWSVLDGTLLTVQFVHAVVNRIIPTTSGFIAPTRHGYLIRENFQCLSAKASPQDPLKNFKKAMWMVKSRQREELVAAAGAPQVLESESAQGNETKSNKCSQVCLIV

SEQ ID NO: 743699 - protein, 253 aa, Homo sapiens
SFLFPEQDYEPTPYRGICKKEGGCRNPFFKQKLTSKCRLIPQAVKRRTEKASCPSPAPELNVILENEKFHLHPVGSQNSREIGTTAKVWTGVTGTQKKEQLLFRKVGEDFVKVGMFDLNLEEQAETQEVQKRGGGNSMNEVGHANSLSIDTIFHVRAASCNTEVFRFYEKVLNELKALLRGQLSPLPILLSAHKTGTDNLLEELGRNFSIFSVQSSLVPLCERRRDLLDWCRWEKGIKCAWLSLFLALSLGLT

SEQ ID NO: 743700 - protein, 520 aa, Homo sapiens
ESREDLVTYRGIAQRLPGNGVASGGGRPGPGVAAGPVRWRHGTEKEREERQSQRHPDCRWARSRGHEQGAGQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 743701 - protein, 72 aa, Homo sapiens
GSSYGMIEDLMRLAIGNLARKAKNSSQVTIWVCVAGERMRLQRWGPEAPHPSFPGSASQWASDTALPPVRLG

SEQ ID NO: 743702 - protein, 115 aa, Homo sapiens [sequence omitted]

SEQ ID NO: 743703 - protein, 87 aa, Homo sapiens
MGPCSVPHLTHCTWQVEEHVSRIREELDREREERNYFQLERDKIHTFWEITRRQLRQENGLNPGGGGCSELRSHHCTPAWATEQDSV

SEQ ID NO: 743704 - protein, 454 aa, Homo sapiens
MSKEQEVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 743705 - protein, 497 aa, Homo sapiens
SGRARWRPLVLFQVKLSPPSFFLAFRRPHAPLPCMGPCSVPHLTHCTWQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 743706 - protein, 248 aa, Homo sapiens [sequence omitted]

SEQ ID NO: 743707 - protein, 195 aa, Homo sapiens
RRQCGQHTDPGAVGVGTVGRQRVPGRCRGGRQHLPSEMSPGEGPHRPPPALSLQVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 743708 - protein, 520 aa, Homo sapiens; identical to SEQ ID NO: 743700

SEQ ID NO: 743709 - protein, 269 aa, Homo sapiens
SGRARWRPLVLFQAPKKKGKKGKAKGTPIVDGLAPEDMSKEQVKLSPPSFFLAFRRPHAPLPCMGPCSVPHLTHCTWQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKRRQLSHIWLPAFYLSLDHLNFRLLSCWYHG

SEQ ID NO: 743710 - protein, 102 aa, Homo sapiens
DLSERPLESPGRSRCLGQKMSLKLPSPLSPQDVLESKNSTIKDLQYELAQVCKAHNDLLRTYEAKLLAFGIPLDNVGFKPLETAVIGQTLGQGPAGLVGTPT

SEQ ID NO: 743711 - protein, 207 aa, Homo sapiens
MKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVSGTTLALQLAVGVRATVHQVHQGERALGWPCSGDGTPASQGRGSPCGPWTSFRCLGQVSGF

SEQ ID NO: 743712 - protein, 491 aa, Homo sapiens
SGRARWRPLVLFQAPKKKGKKGKAKGTPIVDGLAPEDMSKEQEVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 743713 - protein, 526 aa, Homo sapiens
SGRARWRPLVLFQAPKKKGKKGKAKGTPIVDGLAPEDMSKEQVKLSPPSFFLAFRRPHAPLPCMGPCSVPHLTHCTWQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 743714 - protein, 286 aa, Homo sapiens
MKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 743715 - protein, 72 aa, Homo sapiens
AALSSGGPERGDPQLPDTALSPQAHNDLLRTYEAKLLAFGIPLDNVGFKPLETAVIGQTLGQGPAGLVGTPT

SEQ ID NO: 743716 - protein, 441 aa, Homo sapiens
ESREDLVTYRGIAQRLPGNGVASGGGRPGPGVAAGPVRWRHGTEKEREERQSQRHPDCRWARSRGHEQGAGQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVSGTTLALQLAVGVRATVHQVHQGERALGWPCSGDGTPASQGRGSPCGPWTSFRCLGQVSGF

SEQ ID NO: 743717 - protein, 157 aa, Homo sapiens
GQHLPPLLCAGIMELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 743718 - protein, 157 aa, Homo sapiens; identical to SEQ ID NO: 743717

SEQ ID NO: 743719 - protein, 144 aa, Homo sapiens
GQHLPPLLCAGIMELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSLPPRGHLSLMARRVTPWRVQLPAPPCLCRIVWVE

SEQ ID NO: 743720 - protein, 159 aa, Homo sapiens
AIIIIGDDSSVPVILEQAIVIIGDDNSVPVILEQAIVIIGDDSSVPVILEQAIVVVGDDSSVPVILEQAVVVVGDDSSVPVILEQAVVVVGDDSSVPVILEQAVVVVGDDSYVPVILEQAVVVVGDDSSVPVIPPEDLAVGQDADVEDSDTDGPDPVRV

SEQ ID NO: 743721 - protein, 297 aa, Homo sapiens
GTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWASRGPSLLGIQDQGAGTGNKKSQVCSGPAENGGPSGPQWDQVVRRNLHKGGGDKPKRARTSNRK

SEQ ID NO: 743722 - protein, 200 aa, Homo sapiens
GTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAVRQPLVGPCFRDWFPLLLRSNLPAISHIAFCYSVPVVCSLFFFF

SEQ ID NO: 743723 - protein, 295 aa, Homo sapiens
HRTGRGSGERSSHGKPSPAQQRRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHKTQVLIRFPMQRNLVVIPKSVTPERIAENFKVFDFELSSQDMTTLLSYNRNWRVCALLSCTSHKDYPFHEEF

SEQ ID NO: 743724 - protein, 211 aa, Homo sapiens
GTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVVCLGSSELDLGHLGTRSCSDTKVIEFLQRRLGTSVLASTSVLPSTSVLP

SEQ ID NO: 743725 - protein, 324 aa, Homo sapiens
GTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWASPRTLSPWRIPGQRDRSSEHKITASPDRSPAKNWGCSQVGHRRLVNSVLVDWRRLTLIVKNEVACGDPQYSELTVRPKQGCLPRRFQGHW

SEQ ID NO: 743726 - protein, 313 aa, Homo sapiens
GTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHKTQIPKSVTPERIAENFKVFDFELSSQDMTTLLSYNRNWRVCALLSCTSHKDYPFHEEF

SEQ ID NO: 743727 - protein, 315 aa, Homo sapiens
GTVLGGGLGSAAAMASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWASPRTLSPWRIPGQRDRGLPIKLQARPVPVPMQRTCGGPQTLDPNPLWKFKGLPLPSPPFTPLFFQKTWGGGLFSSPQGAPP

SEQ ID NO: 743728 - protein, 44 aa, Homo sapiens
LPGQEPSCRLSVTPESRTTTTGKETVGGLAQSRRATESTVYPAV

SEQ ID NO: 743729 - protein, 118 aa, Homo sapiens
TKKERLRGTEKESHRDREMERQTDRGEPRHRGRGRQRQALPGELGPLCDWLLLENSFPGLQLLCNCFLQLTDFIDFVCFSPSFNLLFAKPSKEPHLRLEGVVSISTLYILSTHLHLKL

SEQ ID NO: 743730 - protein, 367 aa, Homo sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAQVVGVGCVLDGVRYNNGQSFQPNCKYNCTCIDGAVGCTPLCLRVRPPRLWCPHPRRVSIPGHCCEQWVCEDDAKRPRKTAPRDTGAFDAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 743731 - protein, 122 aa, Homo sapiens
MRWFLPWTLAAVTAAAASTVLATAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 743732 - protein, 280 aa, Homo sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAHAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 743733 - protein, 280 aa, Homo sapiens; identical to SEQ ID NO: 743732

SEQ ID NO: 743734 - protein, 319 aa, Homo sapiens
PRAGPGPGACGFRKRRARCLAARLAAMSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 743735 - protein, 195 aa, Homo sapiens
PRAGPGPGACGFRKRRARCLAARLAAMSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQVRLSTLSS

SEQ ID NO: 743736 - protein, 135 aa, Homo sapiens
QQPIDSIRLAAWCFSEQINTLQTRKNITYILGTSQWFNLCAWLGSQVWNTPDIYHSGYYSHRETVNGSWYIQDLCEMLGKYGSSLEFTELLTLVNRKVSQRRVDFCKDPSAIGKKQVPCFASMLTKKLHFFPKSN

SEQ ID NO: 743737 - protein, 230 aa, Homo sapiens
PRAGPGPGACGFRKRRARCLAARLAAMSSASGLRRGHPAVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 743738 - protein, 319 aa, Homo sapiens; identical to SEQ ID NO: 743734

SEQ ID NO: 743739 - protein, 460 aa, Homo sapiens
MNKPITPSTYVRCLNVGLIRKLSDFIDPQEGWKKLAVAIKKPSGDDRYNQFHIRRFEALLQTGKSPTSELLFDWGTTNCTVGDLVDLLIQNEFFAPASLLLPDAVPKTANTLPSKEAITVQQKQMPFCDKDRTLMTPVQNLEQSYMPPDSSSPENKSLEVSDTRFHSFSFYELKNVTNNFDERPISVGGNKMGEGGFGVVYKGYVNNTTVAVKKLAAMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 743740 - protein, 336 aa, Homo sapiens
MPFCDKDRTLMTPVQNLEQSYMPPDSSSPENKSLEVSDTRFHSFSFYELKNVTNNFDERPISVGGNKMGEGGFGVVYKGYVNNTTVAVKKLAAMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 743741 - protein, 257 aa, Homo sapiens
MSQITLMNDPFLLVMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 743742 - protein, 238 aa, Homo sapiens
MNKPITPSTYVRCLNVGLIRKLSDFIDPQEGWKKLAVAIKKPSGDDRYNQFHIRRFEALLQTGKSPTSELLFDWGTTNCTVGDLVDLLIQNEFFAPASLLLPDAVPKTANTLPSKEAITVQQKQMPFCDKDRTLMTPVQNLEQSYMPPDSSSPENKSLEVSDTRFHSFSFYELKNVTNNFDERPISVGGNKMGEGGFGVVYKGYVNNTTVAVKKLAAVSYIFRNKKKELLHSVPYNRF

SEQ ID NO: 743743 - protein, 336 aa, Homo sapiens; identical to SEQ ID NO: 743740

SEQ ID NO: 743744 - protein, 460 aa, Homo sapiens; identical to SEQ ID NO: 743739

SEQ ID NO: 743745 - protein, 460 aa, Homo sapiens; identical to SEQ ID NO: 743739

SEQ ID NO: 743746 - protein, 117 aa, Homo sapiens
TLSPVPTCLLEDVGSRILCLPPAGIVAFTADLQRAQMHLINKECTVLQDGCGVAVWGWAGWSRQEPREAGRTVQGLLTRWKMMGASEGVVGQGQGEGSMRPGSGCRLLRLKFGSDPF

SEQ ID NO: 743747 - protein, 81 aa, Homo sapiens
QDEQRSKPPTTAAVCPVLDKLSAFVRCGRIVVPTSNVAVGIGPQPQTSPTGVCSKRHWPGPAHRLPRPPPPHSTFPEFCQH

SEQ ID NO: 743748 - protein, 122 aa, Homo sapiens
QDEQRSKPPTTAAVCPVLDKLSAFVRCGRIVVPTSNVAVGIGPQPQTSPTGVCSKRHWPGPAHRSPRKENKSTLRTELEVVYLGILHSCKLNVLSLLVLRKCLGTSFYIEGSAYGQNECPWA

SEQ ID NO: 743749 - protein, 153 aa, Homo sapiens
MGSTTNTVPSNQHKSRSTIHATHVKPEQSILSYDQKPGPSERSRATKSGSRGTERTVVMDKSKGVPVISVKTSGSKERAKARIANQPAERLQAPGPSLHERGEEGGALREAQSRAPSCKGQQHGEKDPAFGPGLHLSVTGYKQRHPERVQRGS

SEQ ID NO: 743750 - protein, 586 aa, Homo sapiens
MILSSGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSDCRTRMQAQGSARSVSGWEIGRREGGLQRQGWNESPRAGQVDAKE

SEQ ID NO: 743751 - protein, 575 aa, Homo sapiens
MILSSGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKELRRQQELRYEQERRPAVRRPYDLDRRDDAYWPEAKRAALDERYHSDFNRQD

SEQ ID NO: 743752 - protein, 560 aa, Homo sapiens
MILSSGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSDCRTYATQAQWSAMNETRR

SEQ ID NO: 743753 - protein, 291 aa, Homo sapiens
MSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSDRRTRMQAQGSARSVSGWEIGRREGGLQRQGWNESPRAGQVDAKE

SEQ ID NO: 743754 - protein, 446 aa, Homo sapiens
MILSSGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEDTDSEEEIREAFRVFDKDGNGYISAAELRHVMTKLGEKLQMKKLMND

SEQ ID NO: 743755 - protein, 318 aa, Homo sapiens
MQPQHEFYGFEFVSSMLLPCGVTLSFVSSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSDRRTRMQAQGSARSVSGWEIGRREGGLQRQGWNESPRAGQVDAKE

SEQ ID NO: 743756 - protein, 321 aa, Homo sapiens
GIQRRDSAIHLHKVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSDCRTRMQAQGSARSVSGWEIGRREGGLQRQGWNESPRAGQVDAKE

SEQ ID NO: 743757 - protein, 111 aa, Homo sapiens
MILSSGRKPEEEGVEDNGLEENSGDGQEDVETSLENLQDIDIMDISVLDEAEIDNGSVADCVEDDDADNLQESLSDSRELVEGEMKELPEQLQEHAIVKSDDEVSKLFIVS

SEQ ID NO: 743758 - protein, 34 aa, Homo sapiens
QPHQVSQAPRHRLSLFPPNLVPISFFSDHYPDPS

SEQ ID NO: 743759 - protein, 384 aa, Homo sapiens
MEGLGRSCLWLRRELSPPRPRLLLLDCRSRELYESARIGGALSVALPALLLRRLRRGSLSVRALLPGPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 743760 - protein, 384 aa, Homo sapiens; identical to SEQ ID NO: 743759

SEQ ID NO: 743761 - protein, 355 aa, Homo sapiens
TSLASSLRNKEGTLGSKVGYLDVEARGPGEGRGGGGESPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 743762 - protein, 105 aa, Homo sapiens
MGSQSESCGGGGEEEGLTFAAAGPTQPLLLWGVGKGPSCRHTQSFISVHTPVGGGCACVCLCVRTCRRSHTHASPLMHPAQGWQSLQRGAVSPWSLERIYACLFL

SEQ ID NO: 743763 - protein, 472 aa, Homo sapiens
VSKVEAGSGCQEAAGARAARAARGSASTCEPAPPPRPLLAARPGDSLPRDGASRSAVAVAVARTSTRGRPPPDLAPAPVVQRVGSRSPMEGLGRSCLWLRRELSPPRPRLLLLDCRSRELYESARIGGALSVALPALLLRRLRRGSLSVRALLPGPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 743764 - protein, 472 aa, Homo sapiens; identical to SEQ ID NO: 743763

SEQ ID NO: 743765 - protein, 228 aa, Homo sapiens
TTSTSQPHLIFILADDQGFRDVGYHGSEIKTPTLDKLAAEGVKLENYYVQPICTPSRSQFITGKYQIHTGLQHSIIRPTQPNCLPLDNATLPQKLKEVGYSTHMVGKWHLGFYRKECMPTRRGFDTFFGSLLGSGDYYTHYKCDSPGMCGYDLYENDNAAWDYDNGIYSTQMYTQRVQQILASHNPTKPIFLYIAYQAVHSPLQAPGRYFEHYRSIININRRRYAAML

SEQ ID NO: 743766 - protein, 181 aa, Homo sapiens
VAERYVFPFFSLEKTPMYQIHTGLQHSIIRPTQPNCLPLDNATLPQKLKEVGYSTHMVGKWHLGFYRKECMPTRRGFDTFFGSLLGSGDYYTHYKCDSPGMCGYDLYENDNAAWDYDNGIYSTQMYTQRVQQILASHNPTKPIFLYIAYQAVHSPLQAPGRYFEHYRSIININRRRYAAML

SEQ ID NO: 743767 - protein, 146 aa, Homo sapiens
EEEVPQESWDEGYSTLSIPPEMLASYKSYSSTFHSLEEQQVCMAVDIGRHRWNQVKKEDQEATGPRLSRELLEVVEPEVLQDSLDRCYSTPSSCLEQPDSCQPYGSSFYALEEKHVGFSLDVGEIEKKGKGKIRRGRRSKKKRRRG

SEQ ID NO: 743768 - protein, 155 aa, Homo sapiens
YGGGSHLLLGIMAALRPLVKPKIVKKRTKKFIRHQSDRYVKIKRNWRKPRGIDNRVRRRFKGQILMPNIGYGSNKKTKHMLPSGFRKFLVHNVKELEVLLMCNKSYCAEIAHNVSSKNRKAIVERAAQLAIRVTNPMPGCAVKKMSRQLMCTFSV

SEQ ID NO: 743769 - protein, 369 aa, Homo sapiens
YGGGSHLLLGIMAALRPLVKPKIVKKRTKKFIRHQSDRYVKIKRNWRKPRGIDNRVRRRFKGQILMPNIGYGSNKKTKHMLPSGFRKFLVHNVKELEVLLMCKSYCAEIAHNVSSKNRKAIVERAAQLAIRVTNPNASVRSEENERQLMCNKSYCAEIAHNVSSKNRKAIVERAAQLAIRVTNPMPGCAVKKMSRQLMCTFSVLNKCKNCHLASSFLAFLSLQLLGQTEYCHQRSCFRLSPFGISHIGGDQYQDTQSLEQGNVAYKCTRQPLVISSSTLGYEPYKTWAPHNKGRSRAHLERTLAASKVNNERHSLSPAPRKVKVTTACQCAPPPQSANTPHGTHHTDTTHAHHTQPTRPEQPGHTKRRT

SEQ ID NO: 743770 - protein, 157 aa, Homo sapiens
YGGGSHLLLGIMAALRPLVKPKIVKKRTKKFIRHQSDRYVKIKRNWRKPRGIDNRVRRRFKGQILMPNIGYGSNKKTKHMLPSGFRKFLVHNVKELEVLLMCNKSYCAEIAHNVSSKNRKAIVERAAQLAIRVTNPMPGCAVKKMSRPAHVHVFCFK

SEQ ID NO: 743771 - protein, 376 aa, Homo sapiens
ARRRRGRGRRGCRSSSWGLPRTLLGRRRVPSAGGRGVRGPRSAAVRGDMSAAGLLAPAPAQAGAPPAPEYYPEEDEELESAEDDERSCRGRESDEDTEDASETDLAKHDEEDYVEMKEQMYQDKLASLKRQLQQLQEGTLQEYQKRMKKLDQQYKERIRNAELFLQLETEQVERNYIKEKKAAVKEFEDKKVELKENLIAELEEKKKMIENEKLTMELTGDSMEVKPIMTRKLRRRPNDPVPIPDKRRKPAPAQLNYLLTDEQIMEDLRTLNKLKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 743772 - protein, 376 aa, Homo sapiens; identical to SEQ ID NO: 743771

SEQ ID NO: 743773 - protein, 123 aa, Homo sapiens
MITRLLDYSHIPLLTESCGRKQSLLFLASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 743774 - protein, 106 aa, Homo sapiens
MVELKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 743775 - protein, 376 aa, Homo sapiens; identical to SEQ ID NO: 743771

SEQ ID NO: 743776 - protein, 103 aa, Homo sapiens
LLGSGAISAIIKVISLSFNVAGAFLKSKCWHTGLRLGRPMIVDGASLMSPDETAFPTSFPHSHDWRNDSLGDECWGFLYSCCHLEMFKKFGVRATVSVSMSNQ

SEQ ID NO: 743777 - protein, 74 aa, Homo sapiens
GRYYYYYYYFAAASTCSNIHFTSAWGFCVFPSPHALPTPFSLNHVLLNNFQMDFCSHTKARVFSFMRILVFIDV

SEQ ID NO: 743778 - protein, 143 aa, Homo sapiens
ARRRRGRGRRGCRSSSWGLPRTLLGRRRVPSAGGRGVRGPRSAAVRGDMSAAGLLAPAPAQAGAPPAPEYYPEEDEELESAEDDERSCRGRESDEDTEDASETDLAKHDEEDYVEMKEQYITGISEENEKTRSAVQREDTECR

SEQ ID NO: 743779 - protein, 914 aa, Homo sapiens
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 743780 - protein, 538 aa, Homo sapiens
MASESSPLLAYRLLGEEGVALPANGAGGPGGASARKLSTFLGVVVPTVLSMFSIVVFLRIDATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLESNSHPLP

SEQ ID NO: 743781 - protein, 1206 aa, Homo sapiens
MGVECRTRLVHLGHQGETQAGGLGSRNPACWGGGWLPAIDNLQPAAAMDPVLLQALSLGVRVGSGFLPSLHFHKYLASCAYTIRYDSRVRWLTPVIPALWEAEAGGIAGAQEFQTSLGNRARASPQIQKLARCDGKCLYVLATWEAEVGGLLESKKVEAAVSYDYSTALQPGGWSETLSLKKKEGMTTEGLNPRLPNEYQAYPFSTFDDLSLILKIGAGDFLTPGRMIIRVLLFLLPRTLLQEDYGFFRAISLWPPLVLIGIYATALSASMSSLIGASRILHALARDDLFGGFSASLLAWSTPSLVCLSVPAEALADVSAVDSVFLGVILAPAKVVSRGGNPWAAVLYSWGLVQVSLLLQGALSLTPPAGRMGVQLDAGWETNVKTNAYALGVALALCRVHWHFVGFTSTLQVAPVLCRVHWHPGRFTGTFWGTRALCRVHCHFLGYTSIFQYSLALCGVPQHFEGFTGTLWDVPTLCGGSLILWRFGGTLWECIGPFWGSLTLGVHLHFTGLTGTFQGSLTFGVHWHSLGFIDTLGVRWHFAWFTGTFQGSLTLWGYTGTFWGSLTLGIHWHFWGLIAFLGLIDTLGVHWHFWGLIAFWGFIDTLGVHWHFAGFTGTFWGSLTLWGTLAFFGVHWHFGGALALWNNGTPLGPCPAGAPGWEAEHTGCCGHCLLPGGLCCRGPVLPEPGVGLGPQLPVRDSDLCPQREEGRTRAQAWGWGLQPRVRPALSFCPSSPPARSPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 743782 - protein, 527 aa, Homo sapiens
MLGVHWHFGTTARLLALAQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 743783 - protein, 914 aa, Homo sapiens; identical to SEQ ID NO: 743779

SEQ ID NO: 743784 - protein, 254 aa, Homo sapiens
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFEATVARGPALGTWSPGEV

SEQ ID NO: 743785 - protein, 650 aa, Homo sapiens
MNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 743786 - protein, 876 aa, Homo sapiens
MSPGVRDQPGQHGETPSLLKIQKLARRGGGHLYSQLPERLRQGNCLNLGGRSCSEAEIAPLHSRLGDTARLHLKINKLNKIKKLDGHGGAHLESQLLGRLRQEDRSSPGGRGCSELRWCHCTPAWMTEPDPVSEKINKEIKERGLGSGGRNIGALGGRGNVSGCPRASAGTGWGLSEGSAGEARGPWECVERVAKRPGSLRRMLMHSPPWEDPPAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 743787 - protein, 445 aa, Homo sapiens
MFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 743788 - protein, 760 aa, Homo sapiens
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPA

SEQ ID NO: 743789 - protein, 109 aa, Homo sapiens
GSTNTPASPYLRATHSDLSREISIKAQREPIHFILWTLGPGRNILTDSQHPLRNSNSLALTHQRPLPQQKEDLAVFSLLEEGQENSCIAYFPKAGKECNPSLWVWASPS

SEQ ID NO: 743790 - protein, 69 aa, Homo sapiens
WKVQIQCVLNFRQVFMKMYLELVGPPRCLAPDHTGHELSSRGGGSAVTRLHALIEQKAMVCAGRGGSHL

SEQ ID NO: 743791 - protein, 114 aa, Homo sapiens
MACLTSFCKYSFLQYVSTDLIIQNTLLMFSTKPHLLLDGKDKNNYEIFRILNAPQINRYSKYGSELNVFNRGKMRNLLSGNAQGKGCYGKGKHPLWASFLFTQISGYYRSDHVP

SEQ ID NO: 743792 - protein, 98 aa, Homo sapiens
LFLLFLVAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 743793 - protein, 453 aa, Homo sapiens
MGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 743794 - protein, 150 aa, Homo sapiens
MRGRGSQQQQPTRRQGQKLPSPSPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQLRGRCHHTAGTMGSC

SEQ ID NO: 743795 - protein, 100 aa, Homo sapiens
LKSYKRKPGCDILSESFPIAVDQLTPTFPCVPDPGFVPTHSSVFVESRSQPQPPARITSAVTLQPNSVLGVVAGQRLCFSGDSCNLKRLPRRSGLDLAPL

SEQ ID NO: 743796 - protein, 441 aa, Homo sapiens
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 743797 - protein, 264 aa, Homo sapiens
SENKFYLNKGLNTLHITLKLKEEKKTKNQFVTSHGIGQLLLLSCKLFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 743798 - protein, 474 aa, Homo sapiens
KAGWYGLRCISPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 743799 - protein, 474 aa, Homo sapiens; identical to SEQ ID NO: 743798

SEQ ID NO: 743800 - protein, 474 aa, Homo sapiens; identical to SEQ ID NO: 743798

SEQ ID NO: 743801 - protein, 110 aa, Homo sapiens
PEPDVRCAVLTARPAPRPRAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 743802 - protein, 102 aa, Homo sapiens
GLPGGGGAWRVPCPGPGPLCPRCGRASLSASVWVGVMGVPTHSSVFVESRSQPQPPARITSAVTLQPNSVLGVVAGQRLCFSGDSCNLKRLPRRSGLDLAPL

SEQ ID NO: 743803 - protein, 474 aa, Homo sapiens; identical to SEQ ID NO: 743798

SEQ ID NO: 743804 - protein, 207 aa, Homo sapiens
MRGRGSQQQQPTRRQGQKLPSPSPAGKYESAQPGGTQPEPGLGARMAIHKALVMCLGLPLFLFPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVSELTQRGQANTNQVFLRL

SEQ ID NO: 743805 - protein, 486 aa, Homo sapiens
MRGRGSQQQQPTRRQGQKLPSPSPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 743806 - protein, 484 aa, Homo sapiens
KAGWYGLRCISPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVSELTQRGQANTNQVFLRL

SEQ ID NO: 743807 - protein, 484 aa, Homo sapiens; identical to SEQ ID NO: 743806

SEQ ID NO: 743808 - protein, 484 aa, Homo sapiens; identical to SEQ ID NO: 743806

SEQ ID NO: 743809 - protein, 79 aa, Homo sapiens
AHLQAALEAGTEMACCTKFLSEGAYDIILPRATANSQVMGSANSTLRAEDMYSAQSHQAATPPKDGKNSQVFRNPYVWD

SEQ ID NO: 743810 - protein, 118 aa, Homo sapiens
PAGPASHPPHHQLSTWRPPVPCSLRVGRGSPGWRGPLPWPGVRGDPAALLGGSCCLLFRGLAPALPPDPDLAKRTPGQGVVWKAGLAGTWVFLHLLAQFLLVGGRVPGLGGVPGGGEG

SEQ ID NO: 743811 - protein, 118 aa, Homo sapiens; identical to SEQ ID NO: 743810

SEQ ID NO: 743812 - protein, 163 aa, Homo sapiens
MSLGLLKFQAVGEEDEEDEEGESLDSVKALTAKLQLQTRRPSYLEWTAQVQSQAWRRAQAKPGPGGPGDICGFDSMDSALEWLRRELREMQAQDRQLAGQLLRLRAQLHRLKMDQACHLHQELLDEAELELELEPGAGLALAPLLRHLGLTRMNISARRFTLC

SEQ ID NO: 743813 - protein, 235 aa, Homo sapiens
RKMYERRHSVLYFNARDGVLIVYTVAVGFTNSHTPWHALLTLNFCHLSLGNTASLSLISELQPCPVTHLKPAMSLGLLKFQAVGEEDEEDEEGESLDSVKALTAKLQLQTRRPSYLEWTAQVQSQAWRRAQAKPGPGGPGDICGFDSMDSALEWLRRELREMQAQDRQLAGQLLRLRAQLHRLKMDQACHLHQELLDEAELELELEPGAGLALAPLLRHLGLTRMNISARRFTLC

SEQ ID NO: 743814 - protein, 603 aa, Homo sapiens
PGGGSSWLYDRRCRCQRGPGQGRDAQHRGGRGAGEKGVGATHAPSLQSSSSRSSHAQSARSGGLPAQTPARQPAHEPGPKPGSLRGEEAQGGGVGGGGGCRAAAELLLGAFCMKMAAPTANKAASLGCNNKPAFPELDFRSGARVEELNKLIQEFTKHDQREYDDQRALEIHTAKDFIFSMLGMVQKLDQKLPVANEYLLLSGGVREGVVDLDLDELNVYARGTDYDMDFTLLVPALKLHDRNQPVTLDMRHSALCHSWLSLRLFDEGTISKWKDCCTIVDHINGATNYFFSPTKVADWFYDSISIVLSEIQKKPQRGMPKVEKVEKNGTIISIILGVGSSRMLYDIVPVVSFKGWPAVAQSWLMENHFWDGKITEEEVISGFYLVPACSYKGKKDNEWRLSFARSEVQLKKCISSSLMQAYQACKAIIIKLLSRPKAISPYHLRSMMLWACDRLPANYLAQEDYAAHFLLGLIDDLQHCLVNKMCPNYFIPQCNMLEHLSEETVMLHARKLSSVRSDPAEHLRTAIEHVKAANRLTLELQRRGSTTSIPSPQSDGGDPNQPDDRLAKKLQQLVTENPGKSISVFINPDDVTRPHFRIDDKFF

SEQ ID NO: 743815 - protein, 118 aa, Homo sapiens
VHLAAVHFGFHLGLHLALTIKSFFPAFPIPTIICTPVLPMPACASSMSVLPVPMAISMTAAAFWMAVSISMATTISVTWTIAMPIASLSVTVTAAAPVLSISLSFPVAAPSPFSAVIP

SEQ ID NO: 743816 - protein, 149 aa, Homo sapiens
KGGQEGREAAHPGTKRLPLERTPKGRSAVCSELRSGDLAPGPSAAHSPPRTSRSADRRGGCKDGAGSLRPAPPLTIKAAAGCWGPPRLPPAPLLLRFSLGKSSLSSACNGPQLLLRRWCLLHLRWFLQVQRVQMHLLQEELLLLLPRGL

SEQ ID NO: 743817 - protein, 74 aa, Homo sapiens
GRLLLLNSRPRRHPPAPLLLRFSLGKSSLSSACNGPQLLLRRWCLLHLRWFLQVQRVQMHLLQEELLLLLPRGL

SEQ ID NO: 743818 - protein, 141 aa, Homo sapiens
KGGQEGREAAHPGTKRLPLERTPKGRSAVCSELRSGDLAPGPSAAHSPPRTSRSADRRGGCKDGAGSLRPAPSPDYQSSGRLLGSTTPSTCPTASSLLSWKVQSLLGLQWTPTAPAPLVRNAGFRAWGCSIPRHHRECSWV

SEQ ID NO: 743819 - protein, 141 aa, Homo sapiens; identical to SEQ ID NO: 743818

SEQ ID NO: 743820 - protein, 118 aa, Homo sapiens; identical to SEQ ID NO: 743815

SEQ ID NO: 743821 - protein, 74 aa, Homo sapiens; identical to SEQ ID NO: 743817

SEQ ID NO: 743822 - protein, 149 aa, Homo sapiens; identical to SEQ ID NO: 743816

SEQ ID NO: 743823 - protein, 141 aa, Homo sapiens; identical to SEQ ID NO: 743818

SEQ ID NO: 743824 - protein, 137 aa, Homo sapiens
CFWRGLPWERVRDTEAHPLLNGSTPGDFRGLPWERVRDTEAHPLLNGSTPGDFRGLPWERVRDMEAHPLLNGSTPGDFHGLSWEQVRDMEAHALLNGSTPGDFHGLPWMIHSWGFSAALQMTCTHTKHPEVREALIQ

SEQ ID NO: 743825 - protein, 207 aa, Homo sapiens
GSGRGALPAVPGARLTRRPVHGRTMGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRVKSNI

SEQ ID NO: 743826 - protein, 601 aa, Homo sapiens
GSGRGALPAVPGARLTRRPVHGRTMGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 743827 - protein, 407 aa, Homo sapiens
MSAGPQAMLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 743828 - protein, 598 aa, Homo sapiens
GSGRGALPAVPGARLTRRPVHGRTMGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEESENESKSSKLLLTTNNSGLEKTEAITLVNKCAMPAV

SEQ ID NO: 743829 - protein, 256 aa, Homo sapiens
FSRGARDPKTSPLPPHPAQSGHGRPDAGPELGFSSRPLAAGPGMVSRGAGLARSAPVAGQEGPGFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDSRLGRRSGLVGHQAGGNDSGTEIPPAAGPRLIT

SEQ ID NO: 743830 - protein, 534 aa, Homo sapiens
MGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 743831 - protein, 797 aa, Homo sapiens
ASRDRKCRMGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHIHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 743832 - protein, 712 aa, Homo sapiens
MVTLHRMGPNLQLIEGDAKQLAGMITFTCNLAENVSSKVRQLDLAKNRLYQAIQRADDILDLKFCMDGVQTALRSEDYEQAAAHIHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 743833 - protein, 639 aa, Homo sapiens
ASRDRKCRMGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHIHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAITTVTMIMAGIL

SEQ ID NO: 743834 - protein, 596 aa, Homo sapiens
ASRDRKCRMGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHIHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLEVRGKLPISGQQPSFPMLR

SEQ ID NO: 743835 - protein, 597 aa, Homo sapiens
TRRELTTRRELTTRRSSLLCNKLRMGFPATTFQDIQRGVTSAVNIMHSSLQQGKDTKGIESTDEAKMSFLVTLNNVEVCSENISTLKKTLESDCTKLLQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 743836 - protein, 439 aa, Homo sapiens [sequence omitted]

SEQ ID NO: 743837 - protein, 483 aa, Homo sapiens
MPKVWSDQQEANRCGGGEEYSHSCGMLQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 743838 - protein, 410 aa, Homo sapiens
LWSLLFICLCFTSSEEIKHEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 743839 - protein, 368 aa, Homo sapiens
ASRAGSNRPREGDCPYKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 743840 - protein, 114 aa, Homo sapiens
RSAVKRWGPLLLLSPHLWNLIRYAENTRTQITLALGIKTVVSLSFAARRGKLRGPQAAVLPRSPSTKLSVPRVGASLREVCCCPQPQLQSPNSEIFTCGEKQTIKQLLISSQRN

SEQ ID NO: 743841 - protein, 293 aa, Homo sapiens
SLTPGSATQEICIRALIGVISHLFSFSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 743842 - protein, 518 aa, Homo sapiens
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 743843 - protein, 468 aa, Homo sapiens
MEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 743844 - protein, 518 aa, Homo sapiens; identical to SEQ ID NO: 743842

SEQ ID NO: 743845 - protein, 518 aa, Homo sapiens; identical to SEQ ID NO: 743842

SEQ ID NO: 743846 - protein, 243 aa, Homo sapiens
MGPFGLGFDFLKRNLCCPVAVLKSGQEFCKMRKINFGRKPSWEQLRESDSSPKGEGRMRAVAGSGVYCPNDWGKERGFSNLVAISRLSFILFVVRASERLGKPVCEAGLAESFECRSRWLQGPQSGMPEKGTTRKRRYARSFPFSLQPRRGLGLGFRPTSAQRSSRNSSRRPFRKARRSPALCWAGLALLSAPPGASTRYVLQLNLVGFQRCAKVCEHPPLRCLEIVPIDQTKNNSRRDYKTK

SEQ ID NO: 743847 - protein, 349 aa, Homo sapiens
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKGECDHPWSICFLSYLFLSLGWG

SEQ ID NO: 743848 - protein, 106 aa, Homo sapiens
GGCHSELHHSPWQLQGSDLHPQLLSDAYVPLRPIAGARFKSEGVDVASGITVDWAYDSGIKYAFSFELRDTGQYGFLLPATQIIPTAQETWMALRTIMEHTLNHPY

SEQ ID NO: 743849 - protein, 101 aa, Homo sapiens
PAFHPANVILQYDLAKDAVEALYKVHGIEYIFGSISTTLYVASGITVDWAYDSGIKYAFSFELRDTGQYGFLLPATQIIPTAQETWMALRTIMEHTLNHPY

SEQ ID NO: 743850 - protein, 84 aa, Homo sapiens
SIRPGIFCIGVDLNRNWKSGFGDVASGITVDWAYDSGIKYAFSFELRDTGQYGFLLPATQIIPTAQETWMALRTIMEHTLNHPY

SEQ ID NO: 743851 - protein, 131 aa, Homo sapiens
QLSSSCTTQWPSEESPAACELPSPSPQPYRRCSGDPHAGVSNSYPLSSRSEAQSAPEKPQTAPWPASTCSHWSTFLSFRQGLFCILFEAVQKRACETTFKIPPSLSCPTHLFFPPLTVPSLKNGLTNLGYF

SEQ ID NO: 743852 - protein, 143 aa, Homo sapiens
QSDLSLFSPHFPLFYSTKPPLSSWPVLDGRWMFYFPENQTLALCTPHLRADYPRPAQVRAGLETRGLLPSEPPQQRADSILRSGRADLPASSPRALGLPGSGSVSESGSGSGSESGSGPALRARGGDYGPRRARPGPRGHGRG

SEQ ID NO: 743853 - protein, 113 aa, Homo sapiens
SPSLLAPLAPKNLGSATHLRRHKPTYLLSLAHPCSTSTWGPDTTLSNMQPPHPSSARPQIFPLCSLPPQQLLISEPLPSPCWPSPPCPSSCPSSEKRHFGKACFFSMSPSLYS

SEQ ID NO: 743854 - protein, 353 aa, Homo sapiens
MVGQEAALSLGAAMLEAPGPSDGCELSNPSASRVSCAGQMLEVQPGLYFGGAAAVAEPDHLREAGITAVLTVDSEEPSFKAGPGVEDLWRLFVPALDKPETDLLSHLDRCVAFIGQARAEGRAVLVHCHAGVSRSVAIITAFLMKTDQLPFEKAYEKLQILKPEAKMNEGFEWQLKLYQAMGYEVDTSSAIYKQYRLQKVTEKYPELQNLPQELFAVDPTTVSQGLKDEVLYKCRKCRRSLFRSSSILDHREGSGPIAFAHKRMTPSSMLTTGRQAQCTSYFIEPVQWMESALLGVMDGQLLCPKCSAKLGSFNWYGEQCSCGRWITPAFQIHKNRVDEMKILPVLGSQTGKI

SEQ ID NO: 743855 - protein, 163 aa, Homo sapiens
MVGQEAALSLGAAMLEAPGPSDGCELSNPSASRVSCAGQMLEVQPGLYFGGAAAVAEPDHLREAGITAVLTVDSEEPSFKAGPGVEDLWRLFVPALDKPETDLLSHLDRCVAFIGQARAEGRAVLVHCHAGVSRSVAIITAFLMKTDQLPSTGMVNSALVVGG

SEQ ID NO: 743856 - protein, 121 aa, Homo sapiens
MVGQEAALSLGAAMLEAPGPSDGCELSNPSASRVSCAGQMLEVQPGLYFGGAAAVAEPDHLREAGITAVLTVDSEEPSFKAGPGVEDLWRLFVPALDKPETDLLSHLDRVLLCHPGYSVVA

SEQ ID NO: 743857 - protein, 312 aa, Homo sapiens [sequence omitted]

SEQ ID NO: 743858 - protein, 312 aa, Homo sapiens [sequence omitted]

SEQ ID NO: 743859 - protein, 70 aa, Homo sapiens
DHLREAGITAVLTVDSEEPSFKAGPGVEDLWRLFVPALDKPETDLLSHLDRCVAFIGQARAEGRAVLVHW

SEQ ID NO: 743860 - protein, 427 aa, Homo sapiens
MGGDLVLGLGALRRRKRLLEQEKSLAGWALVLAGTGIGLMVLHAEMLWFGGCSWALYLFLVKCTISISTFLLLCLIVAFHAKEVQLFMTDNGLRDWRVALTGRQAAQIVLELVVCGLHPAPVRGPPCVQDLGAPLTSPQPWPGFLGQGEALLSLAMLLRLYLVPRAVLLRSGVLLNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 743861 - protein, 69 aa, Homo sapiens
LPSANLKDPTDGTVQPIPGVSWLGTSSSQLQVQATGGRTPGSLGKRVLGARIQDSGRLQLPLAELKNWV

SEQ ID NO: 743862 - protein, 427 aa, Homo sapiens; identical to SEQ ID NO: 743860

SEQ ID NO: 743863 - protein, 427 aa, Homo sapiens; identical to SEQ ID NO: 743860

SEQ ID NO: 743864 - protein, 340 aa, Homo sapiens [sequence omitted]

SEQ ID NO: 743865 - protein, 167 aa, Homo sapiens
MWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 743866 - protein, 107 aa, Homo sapiens
MILTASVPPRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 743867 - protein, 84 aa, Homo sapiens
VHRLRSTFRRPPPGDPAMEVSQPFLAPYVHPASSLAPRDGGPSPADLSLTLYKALSSSAATRTHCRCSISQDASTSPRGTWGPG

SEQ ID NO: 743868 - protein, 111 aa, Homo sapiens
KVRDYYDLYPTPTHAKRLFPHLWPNFPAWGRSLRGSTRDLLGFFWESSFTYFVSPTGETGKTSGSAATISTDLSMAKAFSTHNQSWLQFSYRVLAFPLSGSKPFDPEAVCP

SEQ ID NO: 743869 - protein, 454 aa, Homo sapiens [sequence omitted]

SEQ ID NO: 743870 - protein, 595 aa, Homo sapiens
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLGYQVGKPSLISHLEQEEEPRTEERGAHQGACADWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDCGKAFNDPSALRSHARTHLKEKPFDCSQCGNAFRTLSALKIHMRVHTGERPYKCDQCGKAYGRSCHLIAHKRTHTGERPYECHDCGKAFQHPSHLKEHVRNHTGEKPYACTQCGKAFRWKSNFNLHKKNHMVEKTYECKECGKSFGDLVSRRKHMRIHIVKKPVECRQCGKTFRNQSILKTHMNSHTGEKPYGCDLCGKAFSASSNLTAHRKIHTQERRYECAACGKVFGDYLSRRRHMSVHLVKKRVECRQCGKAFRNQSTLKTHMRSHTGEKPYECDHCGKAFSIGSNLNVHRRIHTGEKPYECLVCGKAFSDHSSLRSHVKTHRGEKLFVSSVWKRLQ

SEQ ID NO: 743871 - protein, 595 aa, Homo sapiens; identical to SEQ ID NO: 743870

SEQ ID NO: 743872 - protein, 595 aa, Homo sapiens; identical to SEQ ID NO: 743870

SEQ ID NO: 743873 - protein, 595 aa, Homo sapiens; identical to SEQ ID NO: 743870

SEQ ID NO: 743874 - protein, 595 aa, Homo sapiens; identical to SEQ ID NO: 743870

SEQ ID NO: 743875 - protein, 595 aa, Homo sapiens; identical to SEQ ID NO: 743870

SEQ ID NO: 743876 - protein, 85 aa, Homo sapiens
RKMAMDRGPLGVLFWHVGTGRITRGEALRMPCLRESLQRPLIPQEPRENSPGREALCVIRVEKAPVSAPALETQDDSDRKQTSWV

SEQ ID NO: 743877 - protein, 711 aa, Homo sapiens
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLGYQVGKPSLISHLEQEEEPRTEERGAHQGACADWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDCGKAFNDPSALRSHARTHLKEKPFDCSQCGNAFRTLSALKIHMRVHTGERPYKCDQCGKAYGRSCHLIAHKRTHTGERPYECHDCGKAFQHPSHLKEHVRNHTGEKPYACTQCGKAFRWKSNFNLHKKNHMVEKTYECKECGKSFGDLVSRRKHMRIHIVKKPVECRQCGKTFRNQSILKTHMNSHTGEKPYGCDLCGKAFSASSNLTAHRKIHTQERRYECAACGKVFGDYLSRRRHMSVHLVKKRVECRQCGKAFRNQSTLKTHMRSHTGEKPYECDHCGKAFSIGSNLNVHRRIHTGEKPYECLVCGKAFSDHSSLRSHVKTHLKEKPGDCSQCGNAIRDPSRPLKIHMRVHTGESPYKCDQCGKAYGRSCHLIAHKRTAIVRFALGNNAQEIMTAAFVVVVIGGLGSFWGVVLAALLVGVVRGITVQFYAPAGEASMYLLMLLVLIFRPRVIA

SEQ ID NO: 743878 - protein, 171 aa, Homo sapiens [sequence omitted]

SEQ ID NO: 743879 - protein, 331 aa, Homo sapiens
MDVSVRAAGCSDDLSSGEADVDPKLLELTADEEKCRSIRRQYRQLMYCVRQNREDIVSSANNSLTEALEEANVLFDGVSRTREAALDARFLVMASDLGKEKAKQLNSDMNFFNQLAFCDFLFLFVGLNWMEGDPDKLSDCDDSIALSFWKAIEKEATSWMVKAETFHFVFGSFKLERSAPKPRLEHQKKVRKMEENGNMPTKLQKLDLSSYPEATEKNVERILGLLQTYFRKYPDTPVSYFEFVIDPNSFSRTVENIFYVSFIVRDGFARIRLDEDRLPILEPMNVNQMGEGNDSSCHGRKQGVISLTLQEWKNIVAAFEISEAMITYSSY

SEQ ID NO: 743880 - protein, 104 aa, Homo sapiens
WWESVLPGAGQRCRTEPHLSPLPSEPQALFSRPAGLLSLRPEYTLITVSVPCLPQPRLLLLLASPALRGSPGGRGSSRRGEPRPNSLLLKIQREKVDFDDIQKS

SEQ ID NO: 743881 - protein, 210 aa, Homo sapiens
MEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 743882 - protein, 739 aa, Homo sapiens
MEQLAEHLGDCGLQEGWLLVCRPAEGGARLVPIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 743883 - protein, 828 aa, Homo sapiens
RPLPAALAFVPREVLYKLYKDPAGPSRVLLPVWEAEGLGLRVGAAGPAPGTGSGPLRAARDSIELRRGACVRTTGEELCNGHGLWVKLTKEQLAEHLGDCGLQEGWLLVCRPAEGGARLVPIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 743884 - protein, 714 aa, Homo sapiens
MFPWARAIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 743885 - protein, 649 aa, Homo sapiens
RPLPAALAFVPREVLYKLYKDPAGPSRVLLPVWEAEGLGLREEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 743886 - protein, 739 aa, Homo sapiens; identical to SEQ ID NO: 743882

SEQ ID NO: 743887 - protein, 277 aa, Homo sapiens [sequence omitted]

SEQ ID NO: 743888 - protein, 739 aa, Homo sapiens; identical to SEQ ID NO: 743882

SEQ ID NO: 743889 - protein, 739 aa, Homo sapiens; identical to SEQ ID NO: 743882

SEQ ID NO: 743890 - protein, 210 aa, Homo sapiens; identical to SEQ ID NO: 743881

SEQ ID NO: 743891 - protein, 739 aa, Homo sapiens; identical to SEQ ID NO: 743882

SEQ ID NO: 743892 - protein, 739 aa, Homo sapiens; identical to SEQ ID NO: 743882

SEQ ID NO: 743893 - protein, 739 aa, Homo sapiens; identical to SEQ ID NO: 743882

SEQ ID NO: 743894 - protein, 108 aa, Homo sapiens
MYRPRVKSAEEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 743895 - protein, 592 aa, Homo sapiens
MEQLAEHLGDCGLQEGWLLVCRPAEGGARLVPIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQ

SEQ ID NO: 743896 - protein, 520 aa, Homo sapiens
MEQLAEHLGDCGLQEGWLLVCRPAEGGARLVPIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVSSLIHTPVRSALALGRKGQPNLGSSG

SEQ ID NO: 743897 - protein, 521 aa, Homo sapiens
MEQLAEHLGDCGLQEGWLLVCRPAEGGARLVPIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVCVGHGGEGSISCAFHLGLSSFFSEAAE

SEQ ID NO: 743898 - protein, 238 aa, Homo sapiens
MEQLAEHLGDCGLQEGWLLVCRPAEGGARLVPIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRGEV

SEQ ID NO: 743899 - protein, 106 aa, Homo sapiens
MVAAILQTCPEVLMSGPQVHGVLRPPLFIVHCSDLLNVSLRMTCWGHVQPRNVFPCVYPAQCEPLILALLSPSKSPLGTQRLSDVGGLTATSVPRFIPPPLTTPPR

SEQ ID NO: 743900 - protein, 215 aa, Homo sapiens
MASETEKTHALLQTCSTESLISSLGLGAFCLVADRLLQFSTIQQNDWLRALSDNAVHCVIGMWSWAVVTGIKKKTDFGEIILAGFLASVIDVDHFFLAGSMSLKAALTLPRRPFLHCSTVIPVVVLTLKFTMHLFKLKDSWCFLPWMLFISWTSHHIRDGIRHGLWICPFGKTSPLPFWLYVIITSSLPHICSFVMYLTGTRQMMSSKHGVRIDV

SEQ ID NO: 743901 - protein, 215 aa, Homo sapiens; identical to SEQ ID NO: 743900

SEQ ID NO: 743902 - protein, 215 aa, Homo sapiens; identical to SEQ ID NO: 743900

SEQ ID NO: 743903 - protein, 215 aa, Homo sapiens; identical to SEQ ID NO: 743900

SEQ ID NO: 743904 - protein, 215 aa, Homo sapiens; identical to SEQ ID NO: 743900

SEQ ID NO: 743905 - protein, 215 aa, Homo sapiens; identical to SEQ ID NO: 743900

SEQ ID NO: 743906 - protein, 113 aa, Homo sapiens
MEAALTLPRRPFLHCSTVIPVVVLTLKFTMHLFKLKDSWCFLPWMLFISWTSHHIRDGIRHGLWICPFGKTSPLPFWLYVIITSSLPHICSFVMYLTGTRQMMSSKHGVRIDV

SEQ ID NO: 743907 - protein, 133 aa, Homo sapiens
MAPTEGRSRCSSCCWIELREAGAALTLPRRPFLHCSTVIPVVVLTLKFTMHLFKLKDSWCFLPWMLFISWTSHHIRDGIRHGLWICPFGKTSPLPFWLYVIITSSLPHICSFVMYLTGTRQMMSSKHGVRIDV

SEQ ID NO: 743908 - protein, 215 aa, Homo sapiens; identical to SEQ ID NO: 743900

SEQ ID NO: 743909 - protein, 130 aa, Homo sapiens
MRRFLSTWSWPVSRRPLGRRCGLRPLWPAADVSMAPTEGRSRCSSCCWIELREAGAALTLPRRPFLHCSTVIPVVVLTLKFTMHLFKLKDSWCFLPWMLFISWTSHHIRDGIRHGTRQMMSSKHGVRIDV

SEQ ID NO: 743910 - protein, 215 aa, Homo sapiens; identical to SEQ ID NO: 743900

SEQ ID NO: 743911 - protein, 113 aa, Homo sapiens
KTCIGSSFTFRHDCEATPAMWNSPTALRSTCSPFPWGRPLYWAVWNKTPWTGRLTQQKFISCCSRGWEAQGAGCIFILRPLLMCRQLPSDLCSHWREGVSFGVSSCKDTNPIH

SEQ ID NO: 743912 - protein, 380 aa, Homo sapiens
MCPMLLKNGYNGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 743913 - protein, 355 aa, Homo sapiens
MGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 743914 - protein, 381 aa, Homo sapiens
SRLVGRNLGSNIRNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 743915 - protein, 47 aa, Homo sapiens
STCYAPTGETVLSLSMMLQCFHASRDTKVIQPTALTPAALEEPTKEQ

SEQ ID NO: 743916 - protein, 99 aa, Homo sapiens
TKYRWTEYGLTFTEKWNTDNTLGTKITVEDQLARGLKLTFDSSFSPNTGKKNAKIKTDEFQLHTNVNDGTEFGGSIYQKVNKKLETTVNLAWTAGNSNT

SEQ ID NO: 743917 - protein, 133 aa, Homo sapiens
MTACPRPAGAMHKTGRPHLCRELVSEGVDSCFLPQEKLKPEYLQALPEMLKLYSQFLGKQPWFLGDKITFVDFIAYDVLERNQVFEPSCLDAFPNLKDFISRFEGLEKISAYMKSSRFLPRPVFTKMAVWGNK

SEQ ID NO: 743918 - protein, 133 aa, Homo sapiens; identical to SEQ ID NO: 743917

SEQ ID NO: 743919 - protein, 107 aa, Homo sapiens
ARLVATGRHLYLPRQQPPPSSSADLIILSTNDQTEINATCPRHTALQGRAGAEPRALSMEGALWVVSSLAVSIRKIQIEKKKQSPSCSEVNFKCPFCDVPVAGESWR

SEQ ID NO: 743920 - protein, 116 aa, Homo sapiens
APQRSAWSPAGTTGAGAAAAGAAPGQQWPRHGADGCRPPDRAAARSQRKTKATSLDPALEGCLETSQLASVVADKEAQAQSADMTYQRSQSKLPVKPGLEPRPMTPKPVDSMDLLK

SEQ ID NO: 743921 - protein, 110 aa, Homo sapiens
MLRKADSQQKIRDQLPSWIDQERSWAVATLKIALPSLYQTLCFEDAALWRTYYNNSMCEQEFPSILAKKVSLFQQILVVQALRPDRLQSAMALFACKTLGKCDAFQELDH

SEQ ID NO: 743922 - protein, 708 aa, Homo sapiens
MLRKADSQQKIRDQLPSWIDQERSWAVATLKIALPSLYQTLCFEDAALWRTYYNNSMCEQEFPSILAKKVSLFQQILVVQALRPDRLQSAMALFACKTLGLKEVSPLPLNLKRLYKETLEIEPILIIISPGADPSQELQELANAERSGECYHQVAMGQGQADLAIQMLKECARNGDWLCLKNLHLVVSWLPVLEKELNTLQPKDTFRLWLTAEVHPNFTPILLQSSLKITYESPPGLKKNLMRTYESWTPEQISKKDNTHRAHALFSLAWFHAACQERRNYIPQGWTKFYEFSLSDLRAGYNIIDRLFDGAKDVQWEFVHGLLENAIYGGRIDNYFDLRVLQSYLKQFFNSSVIDVFNQRNKKSIFPYSVSLPQSCSILDYRAVIEKIPEDDKPSFFGLPANIARSSQRMISSQVISQLRILGRSITAGSKFDREIWSNELSPVLNLWKKLNQNSNLIHQKVPPPNDRQGSPILSFIILEQFNAIRLVQSVHQSLAALSKVIRGTTLLSSEVQKLASALLNQKCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 743923 - protein, 708 aa, Homo sapiens; identical to SEQ ID NO: 743922

SEQ ID NO: 743924 - protein, 638 aa, Homo sapiens
MLRKADSQQKIRDQLPSWIDQERSWAVATLKIALPSLYQTLCFEDAALWRTYYNNSMCEQEFPSILAKKVSLFQQILVVQALRPDRLQSAMALFACKTLGLKEVSPLPLNLKRLYKETLEIEPILIIISPGADPSQELQELANAERSGECYHQVAMGQGQADLAIQMLKECARNGDWLCLKNLHLVVSWLPVLEKELNTLQPKDTFRLWLTAEVHPNFTPILLQSSLKITYESPPGLKKNLMRTYESWTPEQISKKDNTHRAHALFSLAWFHAACQERRNYIPQGWTKFYEFSLSDLRAGYNIIDRLFDGAKDVQWEFVHGLLENAIYGGRIDNYFDLRVLQSYLKQFFNSSVIDVFNQRNKKSIFPYSVSLPQSCSILDYRAVIEKIPEDDKPSFFGLPANIARSSQRMISSQVISQLRILGRSITAGSKFDREIWSNELSPVLNLWKKLNQCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 743925 - protein, 708 aa, Homo sapiens; identical to SEQ ID NO: 743922

SEQ ID NO: 743926 - protein, 153 aa, Homo sapiens
MLRKADSQQKIRDQLPSWIDQERSWAVATLKIALPSLYQTLCFEDAALWRTYYNNSMCEQEFPSILAKKVSLFQQILVVQALRPDRLQSAMALFACKTLGLKEVSPLPLNLKRLYKETLEIEPRPVDSVWSSSIPKKSVESNDNKSHLHKREH

SEQ ID NO: 743927 - protein, 131 aa, Homo sapiens
MQSGRFHITKIPIPEKQMSIALGMECDPCGQLTNDLKSLTNLPTLSLNLIINAGISSALVASQDQKAVTPLDPVFTILCVSFISQPADLPGNKERALLHCKLLARSRNIVPATWDAEASVEGELPQIINQK

SEQ ID NO: 743928 - protein, 305 aa, Homo sapiens
MLSRSAFCSLDFLLLLLLLLLLPPLPLPLPPPPPLLPLLLPPPPPPPRPPGGTLAPPWRWALEQPSAAFAPPPPAPGEARGSATPARSTSSQRPSLSSSGLCSPPLLSATEPRLALSPYLRQRAAPAGRLLRLGSPPTPAEPTSSPGTPTPPPPPPPLPALPPPPPPGGGNSSPAPSGSAGSKQPRGDEEEDAGRSRGGGARDRSMPGGVERKAASKRLEVEALRLLCRKRSSSPAAAAPRCIPRSMVPRRRAARAAAPAAAAAASAPESGGPTDARELGSGAGARVGPGAAGSPLPFFLFLFRL

SEQ ID NO: 743929 - protein, 391 aa, Homo sapiens
MSREPTPPLPGDMSTGPIAESWCYTQVKVVKFSYMWTINNFSFCREEMGEVLKSSTFSSGPSDKMKWCLRVNPKGLDDESKDYLSLYLLLVSCPKSEVRAKFKFSLLNAKREETKAMESQRAYRFVQGKDWGFKKFIRRDFLLDEANGLLPDDKLTLFCEVSVVQDSVNISGHTNTNTLKVPECRLAEDLGNLWENTRFTDCSFFVRGQEFKAHKSVLAARSPVFNAMFEHEMEESKKNRVEINDLDPEVFKEMMRFIYTGRAPNLDKMADNLLAAADKYALERLKVMCEEALCSNLSVENVADTLVLADLHSAEQLKAQAIDFINRCSVLRQLGCKDGKNWNSNQATDIMESERDRQHFDKEVMKAYIEDLKERESVPSYTTKVSFSLQL

SEQ ID NO: 743930 - protein, 78 aa, Homo sapiens
IGKEGGSGRRDAVRRRRPPQGLAAITPAATTAASGSQGGHGHRLSGRGVSTRTDRCRPARPGKVLNCVGYYINPERLQ

SEQ ID NO: 743931 - protein, 78 aa, Homo sapiens; identical to SEQ ID NO: 743930

SEQ ID NO: 743932 - protein, 392 aa, Homo sapiens
MSREPTPPLPGDMSTGPIAESWCYTQVKVVKFSYMWTINNFSFCREEMGEVLKSSTFSSGPSDKMKWCLRVNPKGLDDESKDYLSLYLLLVSCPKSEVRAKFKFSLLNAKREETKAMESQRAYRFVQGKDWGFKKFIRRDFLLDEANGLLPDDKLTLFCEVSVVQDSVNISGHTNTNTLKVPECRLAEDLGNLWENTRFTDCSFFVRGQEFKAHKSVLAARSPVFNAMFEHEMEESKKNRVEINDLDPEVFKEMMRFIYTGRAPNLDKMADNLLAAADKYALERLKVMCEEALCSNLSVENVADTLVLADLHSAEQLKAQAIDFINRCSVLRQLGCKDGKNWNSNQATDIMETSGWKSMIQSHPHLVAEAFRALASAQCPQFGIPRKRLKQS

SEQ ID NO: 743933 - protein, 392 aa, Homo sapiens; identical to SEQ ID NO: 743932

SEQ ID NO: 743934 - protein, 105 aa, Homo sapiens
MCEEALCSNLSVENVADTLVLADLHSAEQLKAQAIDFINRCSVLRQLGCKDGKNWNSNQATDIMETSGWKSMIQSHPHLVAEAFRALASAQCPQFGIPRKRLKQS

SEQ ID NO: 743935 - protein, 392 aa, Homo sapiens; identical to SEQ ID NO: 743932

SEQ ID NO: 743936 - protein, 290 aa, Homo sapiens
ISEGNCPERIVTITAPTDAIFKGFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQDKYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 743937 - protein, 290 aa, Homo sapiens; identical to SEQ ID NO: 743936

SEQ ID NO: 743938 - protein, 264 aa, Homo sapiens
MRTLWMALCALSRLWPGAQAGCAEAGRCCPGRDPACFARGWRLDRVYGTCFCDQACRFTGDCCFDYDRACPARPCFVGEWSPWSGCADQCKPTTRVRRRSVQQEPQNGGAPCPPLEERAGCLEYSTPQGQDCGHTYVPAFITTSAFNKERTRQATSPHWSTHTEDAGYCMEFKTESLTPHCALENWPLTRWMQYLREGYTVCVDCQPPAMNSVSLRCSGDGLDSDGNQTLHWQAIGNPRCQGTWKKVRRVDQCSCPAVHSFIFI

SEQ ID NO: 743939 - protein, 264 aa, Homo sapiens; identical to SEQ ID NO: 743938

SEQ ID NO: 743940 - protein, 103 aa, Homo sapiens
PPDHASNPACPHMVACHPRLHYTFKASHCLQYAISSRGLEGCHDQTPSPAPWTFYQPQGCHASLAFLFSFSVHLRPLVQTHNLGLANHSISFPDCSVGSKMDV

SEQ ID NO: 743941 - protein, 119 aa, Homo sapiens
TRPTPDSSVQRVRARAGGCLPGEGRGCPRGLHCFWKDHKEKPPPRRDATRGPLRSRSRPAGGRMSPRVARVFGCPQVTPHRSQPPRLVKGRRTHFCKEGAQRPLPGELFPSTRGLIIYI

SEQ ID NO: 743942 - protein, 87 aa, Homo sapiens
QIWLEQIQKTSYLPQADDVPTDHISHVRSSATVEHVCAEETGTTTGMSCGRTGAPCGPSAQNSGGPTMCGSSVRLKVSARPSSHIVR

SEQ ID NO: 743943 - protein, 110 aa, Homo sapiens
SHFYSRNTLFPNIFVFWKSRFSYLGNLLYFILVLYSMSFSLGELQVELLCWLRLHLVELKVTLGHTSQVLHHRPQNYLYKTECKCRHSSTKLFLAIKSVPLVLQILPPTL

SEQ ID NO: 743944 - protein, 60 aa, Homo sapiens
ARVAATSEASVSPGSGNVTEYQSFEPPPDPSKVASLSGICVLGTYPLLHTLSSISSASSA

SEQ ID NO: 743945 - protein, 375 aa, Homo sapiens [sequence omitted]

SEQ ID NO: 743946 - protein, 295 aa, Homo sapiens
AGYRHLLNLFIFDTHLTPTSPVGHFAKWSGSPCSRNREEADMWTTFRPRSSSNASSVSTRLSPLRPESEVLAEEIPASVSSYAGGVPPTLNEGLELLDGLNLTSSHSLLSRSGLSGFSLQHPGVTGPLHTYSSSLFSPAEGPLSAGEGCFSSSQALEALLTSDTPPPPADVLMTQVDPILSQAPTLLLLGGLPSSSKLATGVGLCPKPLEAPGPSSLVPTLSMIAPPPVMASAPIPKALGTPVLTPPTEAASQDRMPQDLDLDMYMENLECDMDNIISDLMDEGEGLDFNFEPDP

SEQ ID NO: 743947 - protein, 501 aa, Homo sapiens
MRIQPQKAAAIIDLDPDFEPQSRPRSCTWPLPRPEIANQPSEPPEVEPDLGEKVHTEGRSEPILLPSRLPEPAGGPQPGILGAVTGPRKGGSRRNAWGNQSYAELISQAIESAPEKRLTLAQIYEWMVRTVPYFKDKGDSNSSAGWKNSIRHNLSLHSKFIKVHNEATGKSSWWMLNPEGGKSGKAPRRRAASMDSSSKLLRGRSKAPKKKPSVLPAPPEGATPTSPVGHFAKWSGSPCSRNREEADMWTTFRPRSSSNASSVSTRLSPLRPESEVLAEEIPASVSSYAGGVPPTLNEGLELLDGLNLTSSHSLLSRSGLSGFSLQHPGVTGPLHTYSSSLFSPAEGPLSAGEGCFSSSQALEALLTSDTPPPPADVLMTQVDPILSQAPTLLLLGGLPSSSKLATGVGLCPKPLEAPGPSSLVPTLSMIAPPPVMASAPIPKALGTPVLTPPTEAASQDRMPQDLDLDMYMENLECDMDNIISDLMDEGEGLDFNFEPDP

SEQ ID NO: 743948 - protein, 501 aa, Homo sapiens; identical to SEQ ID NO: 743947

SEQ ID NO: 743949 - protein, 66 aa, Homo sapiens
LAPAPEERMRQLEHQSPLRRACFHKMERITNNNSSPETASLLQNSTPKPRRTPRYTLSHHYHFLGL

SEQ ID NO: 743950 - protein, 100 aa, Homo sapiens
MAPFVRNLVEKTPALVNAAVTYLKPRLAAFWYYTTVELVPPTPAEIPRAIQSLKKIVSSAQTGSFKQLTVKEALLNGLVATEVSTWFYVREITGKRGIIG

SEQ ID NO: 743951 - protein, 170 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHR

SEQ ID NO: 743952 - protein, 261 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 743953 - protein, 261 aa, Homo sapiens; identical to SEQ ID NO: 743952

SEQ ID NO: 743954 - protein, 275 aa, Homo sapiens
MAATAREDGASGQERGQRGCEHYDRGCLLKVTPSMDSSLTSFRQAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 743955 - protein, 239 aa, Homo sapiens
MAPAVKSEAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 743956 - protein, 261 aa, Homo sapiens; identical to SEQ ID NO: 743952

SEQ ID NO: 743957 - protein, 252 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRGYRCPLCMHSALDMTRYWRQLDDEVAQTPMPSEYQNMTVDILCNDCNGRSTVQFHILGMKCKICESYNTAQAGGRRISLDQQ

SEQ ID NO: 743958 - protein, 252 aa, Homo sapiens; identical to SEQ ID NO: 743957

SEQ ID NO: 743959 - protein, 230 aa, Homo sapiens
MAPAVKSEAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRGYRCPLCMHSALDMTRYWRQLDDEVAQTPMPSEYQNMTVDILCNDCNGRSTVQFHILGMKCKICESYNTAQAGGRRISLDQQ

SEQ ID NO: 743960 - protein, 619 aa, Homo sapiens
MTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 743961 - protein, 619 aa, Homo sapiens; identical to SEQ ID NO: 743960

SEQ ID NO: 743962 - protein, 645 aa, Homo sapiens
MSLKLPKERDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 743963 - protein, 606 aa, Homo sapiens
MSLKLPKERDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 743964 - protein, 692 aa, Homo sapiens
PCSLTRSSPASEHSMAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 743965 - protein, 692 aa, Homo sapiens; identical to SEQ ID NO: 743964

SEQ ID NO: 743966 - protein, 655 aa, Homo sapiens
PCSLTRSSPASEHSMAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 743967 - protein, 503 aa, Homo sapiens [sequence omitted]

SEQ ID NO: 743968 - protein, 488 aa, Homo sapiens
KLGTRPRAKENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 743969 - protein, 692 aa, Homo sapiens; identical to SEQ ID NO: 743964

SEQ ID NO: 743970 - protein, 290 aa, Homo sapiens
MPEEEMVGEFWLTDVVFLIRVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 743971 - protein, 610 aa, Homo sapiens
PCSLTRSSPASEHSMAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFDLSQLCTGTMT

SEQ ID NO: 743972 - protein, 458 aa, Homo sapiens
PCSLTRSSPASEHSMAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCVSITVRRFL

SEQ ID NO: 743973 - protein, 1047 aa, Homo sapiens
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKKNRILDKSAPLTSSNTSIPTPSSSPFKTSSILVNAAFYQALCDQEGWDTPINYSKTHGKTEEEKEKDPVSSLENLEEKKFPGEASIPSPKPKLHARDLKKELITCPTPGCDGSGHVTGNYASHRSVSGCPLADKTLKSLMAANSQELKCPTPGCDGSGHVTGNYASHRSLSGCPRARKGGVKMTPTKEEKEDPELKCPVIGCDGQGHISGKYTSHRTASGCPLAAKRQKENPLNGASLSWKLNKQELPHCPLPGCNGLGHVNNVFVTHRSLSGCPLNAQVIKKGKVSEELMTIKLKATGGIESDEEIRHLDEEIKELNESNLKIEADMMKLQTQITSMESNLKTIEEENKLIEQNNESLLKELAGLSQALISSLADIQLPQMGPISEQNFEAYVNTLTDMYSNLERDYSPECKALLESIKQAVKGIHV

SEQ ID NO: 743974 - protein, 1047 aa, Homo sapiens; identical to SEQ ID NO: 743973

SEQ ID NO: 743975 - protein, 122 aa, Homo sapiens
MLQARNQSPSSQRPLDVLRRNQDPQSPASISVIIFITPKEEPALQEGLHLQEDGLPATAEDAATCLTVLSSQPASCRASLLLKELMGRACLAHTCEHSTEKWEHSTGNLGAQYWEMGAQYLG

SEQ ID NO: 743976 - protein, 177 aa, Homo sapiens
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETK

SEQ ID NO: 743977 - protein, 147 aa, Homo sapiens
SIPMFSCFLCILSFSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGP

SEQ ID NO: 743978 - protein, 102 aa, Homo sapiens
VSRHCVFPTFSLSPRCCRGVDKPCVYLRIMPSSQSQLLHEISMAGCGCLTVFSLDKSLREVGVVGDGYLLAWGAFSVHPCTLPHLFKGRKVWKREAHGRGGG

SEQ ID NO: 743979 - protein, 106 aa, Homo sapiens
DSNLELTSVAKSIGHFPHKVKRSSCVHCSVAWHASMLASQTGPARVALLANFTPFSEGHWEMEGKRLVLEKEKIGRPDVHPKIGLPRKWVSVSILTSSIFIYSMLT

SEQ ID NO: 743980 - protein, 366 aa, Homo sapiens
SRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 743981 - protein, 297 aa, Homo sapiens
SRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGLSSASFSLRISNVISTSSGRELSSSRRL

SEQ ID NO: 743982 - protein, 393 aa, Homo sapiens
SALYPPLLSLPPRPFMAGSYPEGAPAVLADKRQQFGSRFLRDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 743983 - protein, 393 aa, Homo sapiens; identical to SEQ ID NO: 743982

SEQ ID NO: 743984 - protein, 242 aa, Homo sapiens [sequence omitted]

SEQ ID NO: 743985 - protein, 330 aa, Homo sapiens
SALYPPLLSLPPRPFMAGSYPEGAPAVLADKRQQFGSRFLRDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMMLLRDYGRYDMAQLRFKKGILKVLNPNH

SEQ ID NO: 743986 - protein, 242 aa, Homo sapiens [sequence omitted]

SEQ ID NO: 743987 - protein, 396 aa, Homo sapiens
YPRRLLVVLPDMSAPFRKPAFVKDLRARFHHIVCHSCASGHAPDSRAMSSECKTFHAHAAILRVVPSTHWFLMTLQVPNTTSCNDFLMKNALDPWESSFQVKTFAPSVSDTYPESGHPQSNHRSIFSGRDWVPWKHSLREVPECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 743988 - protein, 108 aa, Homo sapiens
MQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 743989 - protein, 192 aa, Homo sapiens
HLLLRSILEDPHFYKNNDPGLFVYCCDFSSTAIELVQTNSEYDPSRCFAFVHDLCDEEKSYPVPKGSLDIIILIFVLSAIVPDKMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 743990 - protein, 252 aa, Homo sapiens
SALYPPLLSLPPRPFMAGSYPEGAPAVLADKRQQFGSRFLRDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQVSTMGNYLLVISTD

SEQ ID NO: 743991 - protein, 160 aa, Homo sapiens
SALYPPLLSLPPRPFMAGSYPEGAPAVLADKRQQFGSRFLRDPARVFHHNAWMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 743992 - protein, 219 aa, Homo sapiens
SALYPPLLSLPPRPFMAGSYPEGAPAVLADKRQQFGSRFLRDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTPPVEENVTQKISDLEICADEFPGSSATYRILELAVCGRLPFYQNMQALVL

SEQ ID NO: 743993 - protein, 67 aa, Homo sapiens
VRIEVRRIIRELLKSFKQKLMVAWIRLFKREGEKSLDSGYILDVKPTRFIGRLDVKIEGKKRIMKNP

SEQ ID NO: 743994 - protein, 1610 aa, Homo sapiens
MNTPKEEFQDWPIVRIAAHLPDLIVYGHFSPERPFMDYFDGVLMFVDISGFTAMTEKFSSAMYMDRGAEQLVEILNYHISAIVEKVLIFGGDILKFAGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVVGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 743995 - protein, 1609 aa, Homo sapiens
MNTPKEEFQDWPIVRIAAHLPDLIVYGHFSPERPFMDYFDGVLMFVDISGFTAMTEKFSSAMYMDRGAEQLVEILNYHISAIVEKVLIFGGDILKFAGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVVGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKRCMRLGDTASPYYIFKSDLTLVCTRAKICLMMLGGEAEVMRVVQGLTSSSTSQNDPGKGSGGDSSIHLKTEDQLLTDVGMLFKAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWECEAGVEQETTHFQRPRYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 743996 - protein, 524 aa, Homo sapiens
MDSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKESWYSTSELKEDQWLQTILSLPSWEKIVAGRVNIQDLQKNKFLMRANTVDNHF

SEQ ID NO: 743997 - protein, 192 aa, Homo sapiens
VLMIAAFLQPIRDVQRESEGEKKSVPFWSTLLSTFKLYRDKRLCLLILLPLYSGLQQGFLSSEYTRSYVTCTLGIQFVGYVMICFSATDALCSVLYGKVSQYTGRAVLYVLGAVTHVSCMIALLLWRPRADHLAVFFVFSGLWGVADAVWQTQNNALYGVLFEKSKEAAFANYRLWEALGFVIAFGYSMFLC

SEQ ID NO: 743998 - protein, 489 aa, Homo sapiens
FPWLRELTLPNRPATVLSQTLAPSGSVVPECDSIPTPAAAQDPPDPGLDMGDLELLLPGEAEVLVRGLRSFPLREMGSEGWNQQHENLEKLNMQAILDATVSQGEPIQELLVTHGKVPTLVEELIAVEMWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDSLSLSTLSRMLSTHNLPCLLVELLEHSPWSRREGGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 743999 - protein, 484 aa, Homo sapiens
FPWLRELTLPNRPATVLSQTLAPSGSVVPECDSIPTPAAAQDPPDPGLDMGDLELLLPGEAEVLVRGLRSFPLREMGSEGWNQQHENLEKLNMQAILDATVSQGEPIQELLVTHGKVPTLVEELIAVEMWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDRQWSVSQPPQLAHLKRIQRLHPVCWFLSPGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 744000 - protein, 82 aa, Homo sapiens
FPWLRELTLPNRPATVLSQTLAPSGSVVPECDSIPTPAAAQDPPDPGLDMGDFLPHPVGRPSVLLQQTGPGGPGPDVGTLFL

SEQ ID NO: 744001 - protein, 489 aa, Homo sapiens; identical to SEQ ID NO: 743998

SEQ ID NO: 744002 - protein, 361 aa, Homo sapiens
MWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDSLSLSTLSRMLSTHNLPCLLVELLEHSPWSRREGGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 744003 - protein, 443 aa, Homo sapiens
FPWLRELTLPNRPATVLSQTLAPSGSVVPECDSIPTPAAAQDPPDPGLDMGDLELLLPGEAEVLVRGLRSFPLREMGSEGWNQQHENLEKLNMQAILDATVSQGEPIQELLVTHGKVPTLVEELIAVEMWKQKVFPVFCRVEDFKPQNTFPIYMVVHHEASIINLLETVFFHKELQKQAELMEFEIALKALSVLRYITDCVDSLSLSTLSRMLSTHNLPCLLVELLEHSPWSRREGGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 744004 - protein, 395 aa, Homo sapiens
MWKQKVFPVFCRVEDFKPQNTFPIYMVVHHEASIINLLETVFFHKEVCESAEDTVLDLVDYCHRKLTLLVAQSGCGGPPEGEGSQDSNPMQVGVRLPRVVKSLGLGSPRPAQVRVAQREHCVTSQELQKQAELMEFEIALKALSVLRYITDCVDSLSLSTLSRMLSTHNLPCLLVELLEHSPWSRREGGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 744005 - protein, 84 aa, Homo sapiens
MCPLLRLTLLWGQQPYSLGKSCSPGSPIPRQWSVSQPPQLAHLKRIQRLHPVCWFLSPGKLQQFEGSRWHTVAPSEQQKLSKLD

SEQ ID NO: 744006 - protein, 71 aa, Homo sapiens
GRPFGRRGDLTSFFSIAHAQFPGRVRRALLEPGGSGERPAAAHSTLRGPYWACASESRWRANTNFCSLQNG

SEQ ID NO: 744007 - protein, 215 aa, Homo sapiens
NTYWPLVSDFINILSHQSVAKRFLEDHGLLVTWMNFVSFFQGMNLNKRELNEHVEFESQTYYAAFAAELEACAQPMWGLLSHCKVRETQEYTRNVVRYCLEALQDWFDAINFVDEPAPNQVTFHLPLHRYYAMFLSKAVKCQELDLDSVLPDQEMLMKLMIHPLQIQASLAEIHSNMWVRNGLQIKGQAMTYVQSHFCNSMIDPDIYLLQVSQLD

SEQ ID NO: 744008 - protein, 115 aa, Homo sapiens
MSACLFLWELRPSEAQTCCQPKCACRTRLETLVGRSHPVRRNGIRELLKEAVCPCFHRSAVLCWGTASTPGWCGLPKAWRPEQLSRPNSKDGGPSLSGSSVPGRIQISVSQRTPV

SEQ ID NO: 744009 - protein, 92 aa, Homo sapiens
QVPASACLCTWGWESHLVTPLLPLTSFPLSPRSVRFPLEPEGSPVPASLPERPSPRHPASSSGRLQDPGETRNRLGTRARDPDRLGAASKGS

SEQ ID NO: 744010 - protein, 68 aa, Homo sapiens
REALLYPLVGKVEGGVCRTRVPATRCPLPARPAQEQKEARCQPAFLKDQARAIRLPPVDACRTQECFS

SEQ ID NO: 744011 - protein, 47 aa, Homo sapiens
MRMCVSSCFAPSSPKNLLPQFHPGGTPPAWGPGGDRQANGAPGAGRA

SEQ ID NO: 744012 - protein, 97 aa, Homo sapiens
REALLYPLVGKVEGGVCRTRVPATRCPLPARPAQEQKEARCQPAFLKDQARAIRLPPVDACRTQEHYINTVGGDLDTEDSCFKKIQSSLKGCNLYAF

SEQ ID NO: 744013 - protein, 156 aa, Homo sapiens
REALLYPLVGKVEGGVCRTRVPATRCPLPARPAQEQVECKQLKKIPSQSEYHPQDNEENLSSVPTHEMLGGGEDWKRSKGRGRVSSCKKSLHLSAVPGKRAHVLEGSPVPASLPERPSPRHPASSSGRLQDPGETRNRLGTRARDPDRLGAASKGS

SEQ ID NO: 744014 - protein, 516 aa, Homo sapiens
ALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 744015 - protein, 442 aa, Homo sapiens
ALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECSNCPGILKISP

SEQ ID NO: 744016 - protein, 32 aa, Homo sapiens
MEPLQLLFELPSAVPVSKALPSSVCALGAQGM

SEQ ID NO: 744017 - protein, 32 aa, Homo sapiens; identical to SEQ ID NO: 744016

SEQ ID NO: 744018 - protein, 80 aa, Homo sapiens
MAQKLVLLQSCSWEGLQVQGVLSGGVSEEGTQLGYSKQEVPSGRRHLASGKWGGGFSPPLALPIQAFPPPYPPTDPIDPR

SEQ ID NO: 744019 - protein, 66 aa, Homo sapiens
WWGVSISRLPTPKVHITQGRKPSCIIGCFATVWPLEDAIGSVLPVSGQELIFTKEFWMWANKMRLV

SEQ ID NO: 744020 - protein, 113 aa, Homo sapiens
GKDVRQASRTPLAAPERAHCKGGQQTVESPGAELDTASEGRNEVAAVPGPGHARPLFSEPSAVSARPARTLSGPSASPRRPAERRCSESPRDCCAGPAAASRTQHPTALWASC

SEQ ID NO: 744021 - protein, 423 aa, Homo sapiens
MLPWKKHKFELLAEAPPRQASKPKGYAVSLHYSALSSLARACPEGALSRVGSMFRSKRKKLHITSEDPTYTVLYLGNATTIQARGDGCTDLAVGKIWSKSEAGRQGTKMKLTVSAQGIRMVHAEERALRRPGHLYLLHRVTYCVADARLPKVFAWVYRHELKHKAVMLRCHAVLVSKPEKAQAMALLLYQTSANALAEFKRLKRRDDARHQQQELVGAHTIPLVPLRKLLLHGPCCYKPPVERSRSAPKLGSITEDLLGEQLEQELQEEEEEEQPEGCPEEEENRAAEGDPAEEEAEAQRALVVAMHFECGDLLDTLENGRGEALGGGGGSLGPGAGPPPLLLGSASDMKAELSQLISDLGELSFGNDVRTLQADLRVTRLLSGDSTGSESSIEGGGPDATSATAGDSSRQADGASADEPHSG

SEQ ID NO: 744022 - protein, 344 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 744023 - protein, 344 aa, Homo sapiens; identical to SEQ ID NO: 744022

SEQ ID NO: 744024 - protein, 344 aa, Homo sapiens; identical to SEQ ID NO: 744022

SEQ ID NO: 744025 - protein, 166 aa, Homo sapiens [sequence omitted]

SEQ ID NO: 744026 - protein, 344 aa, Homo sapiens; identical to SEQ ID NO: 744022

SEQ ID NO: 744027 - protein, 344 aa, Homo sapiens; identical to SEQ ID NO: 744022

SEQ ID NO: 744028 - protein, 154 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIDVTLL

SEQ ID NO: 744029 - protein, 361 aa, Homo sapiens [sequence omitted]

SEQ ID NO: 744030 - protein, 209 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQVHLTREATW

SEQ ID NO: 744031 - protein, 317 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQVPKLEGEGVINKSAYNLLFSPNPTSFPHTA

SEQ ID NO: 744032 - protein, 107 aa, Homo sapiens
FFPSRSSAASGIFFFHLPSPAPTSDWRLRAKYLAEGLHFSTHLERPQRRRLCAECGADLGSGGVRAGGSPGTGVRFPSPVRCSEHPQDFPHGSCPGCLRRFPENLLV

SEQ ID NO: 744033 - protein, 107 aa, Homo sapiens; identical to SEQ ID NO: 744032

SEQ ID NO: 744034 - protein, 107 aa, Homo sapiens; identical to SEQ ID NO: 744032

SEQ ID NO: 744035 - protein, 107 aa, Homo sapiens; identical to SEQ ID NO: 744032

SEQ ID NO: 744036 - protein, 117 aa, Homo sapiens
RYLFWHCGLCQECCLHLSLLSHPSRPASMPPPPWSLLGVLHCLRLPPATSTVSTTHVICLIIHVPCVHLTELYGGPALCQTLLGWATAMTKKYRAPALRPCVLSPTHPNQEQLAPRT

SEQ ID NO: 744037 - protein, 45 aa, Homo sapiens
ERAENLPHHLFDLDHCREGQQRQGEKSKMMEEGKVIAFAPPPNQL

SEQ ID NO: 744038 - protein, 95 aa, Homo sapiens
VDPVRATQEIQTPANLGPGWGCTGGTLVSEGSLGANGQLKLPVTTIRLPHQLATRAQRTLRTMGAQCLSQGRLVKMEYLQMLLKQPLNFNWSPVM

SEQ ID NO: 744039 - protein, 137 aa, Homo sapiens
RVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFPGGLGRRKLA

SEQ ID NO: 744040 - protein, 93 aa, Homo sapiens
MVPGGAESHNQQLFVMFAFNSSGEPFFDSAALNLFFVETQGGYLVLSEDFVGNGINRTELNQKHSQNLFVMFAFNSQVLNLSLNSAALKHSFL

SEQ ID NO: 744041 - protein, 825 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 744042 - protein, 407 aa, Homo sapiens
ENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRKHVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 744043 - protein, 839 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 744044 - protein, 612 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTWVFSNIDNHGILNLKDNRDHLVPSTHYIYEEPEVQSGEVSYPRSHGFREIMLNPISLPGHSKPLNHGIYVEDVNVYFSKGRHGF

SEQ ID NO: 744045 - protein, 612 aa, Homo sapiens; identical to SEQ ID NO: 744044

SEQ ID NO: 744046 - protein, 817 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 744047 - protein, 719 aa, Homo sapiens
MELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 744048 - protein, 559 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTCFREIMLNPISLPGHSKPLNHGIYVEDVNVYFSKGRHGF

SEQ ID NO: 744049 - protein, 594 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTWVFSNIDNHGILNLKDNRDHLVPSTHYIYEEPEVQSGEVSYPRSHGLFQQRTSWLLKTPFKPPCFDVTLVGWAL

SEQ ID NO: 744050 - protein, 495 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKDGLELLAVLLKCDSKQLKNKEGNKMKNNNGKKKRATSA

SEQ ID NO: 744051 - protein, 461 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGELS

SEQ ID NO: 744052 - protein, 324 aa, Homo sapiens
MRIPVCTHSTRREAPSPERLSSFSTATHVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 744053 - protein, 145 aa, Homo sapiens
MWETATAWASILSSDVYWGGDVKRLGFAGLPRTQAGGVRVITGQGKKCHHQPHGQSFLWVEVFACLFTHFVWLPDLPEISVSHVNLTVREGDNAVITCNGSGSPLPDVDWIVTGLQSINTHQVGILGFSPIRRLGSDHTVVLKKR

SEQ ID NO: 744054 - protein, 445 aa, Homo sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 744055 - protein, 445 aa, Homo sapiens; identical to SEQ ID NO: 744054

SEQ ID NO: 744056 - protein, 445 aa, Homo sapiens; identical to SEQ ID NO: 744054

SEQ ID NO: 744057 - protein, 445 aa, Homo sapiens; identical to SEQ ID NO: 744054

SEQ ID NO: 744058 - protein, 445 aa, Homo sapiens; identical to SEQ ID NO: 744054

SEQ ID NO: 744059 - protein, 445 aa, Homo sapiens; identical to SEQ ID NO: 744054

SEQ ID NO: 744060 - protein, 281 aa, Homo sapiens
MAAPTPARPVLTHLLVALFGMGSWAAVNGIWVELPVVVKELPEAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 744061 - protein, 111 aa, Homo sapiens
MAAPTPARPVLTHLLVALFGMGSWAAVNGIWVELPVVVKELPEGAVVGAVSWRVLLREGGSQLPAAWRGPAGIAGSRRGHPGGLSARRCCYVPPDQHLSRVPQQKGLCRPL

SEQ ID NO: 744062 - protein, 201 aa, Homo sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGFPGWARARSRLGARDQWGL

SEQ ID NO: 744063 - protein, 36 aa, Homo sapiens
MAAPTPARPVLTHLLVALFGMGSWAAVNGIWVELPV

SEQ ID NO: 744064 - protein, 445 aa, Homo sapiens; identical to SEQ ID NO: 744054

SEQ ID NO: 744065 - protein, 445 aa, Homo sapiens; identical to SEQ ID NO: 744054

SEQ ID NO: 744066 - protein, 445 aa, Homo sapiens; identical to SEQ ID NO: 744054

SEQ ID NO: 744067 - protein, 419 aa, Homo sapiens
LGLELRGTGLIGEELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 744068 - protein, 201 aa, Homo sapiens; identical to SEQ ID NO: 744062

SEQ ID NO: 744069 - protein, 72 aa, Homo sapiens
NKLESAVNRTGPEPPRVSRVVAAAGSCALRTEVASLGRTAVSRRGGKPALERERTGRGTGRRRDRTAPESPT

SEQ ID NO: 744070 - protein, 135 aa, Homo sapiens
VSEPLPGPSHEKGNRIVNGQGEGPPAKHPSLKPTTGVEDPAVKGAVQRKNVQTLRAEQALPVASEEEQERHERSEKKQPQVKKGNNTNKSEKIQLSENICDSTSSAAAGRLTQQRKIGKTYPQQFPKKLKEEHDK

SEQ ID NO: 744071 - protein, 58 aa, Homo sapiens
MISSAISADLGRQELIQRSSEALATVTGIVDGSGSIGAAVGQYLGSLIRDNPGCGTVP

SEQ ID NO: 744072 - protein, 633 aa, Homo sapiens
MGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 744073 - protein, 633 aa, Homo sapiens; identical to SEQ ID NO: 744072

SEQ ID NO: 744074 - protein, 633 aa, Homo sapiens; identical to SEQ ID NO: 744072

SEQ ID NO: 744075 - protein, 166 aa, Homo sapiens
MGEEGSELPVCASCGQRIYDGQYLQALNADWHADCFSGHCYYQTVVTPVIEQILPDSPGSHLPHTVTLVSIPASSHGKRGLSVSIDPPHGPPGCGTDFFPITVRCCDLDPEKRPSFVKLEHWLETLRMHLAGHLPLGPQLEQLDRGFWETYRRGESGLPAHPEVPD

SEQ ID NO: 744076 - protein, 227 aa, Homo sapiens
MGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEVRS

SEQ ID NO: 744077 - protein, 90 aa, Homo sapiens
RKDLGRSESLRVVCRPHRIFRPSDLIHGEVLGKGCFGQAIKVQSMPGSQGTVWVGPLHPPSFPVYGNTVEGVSGFQTPWPVPSPPLASWS

SEQ ID NO: 744078 - protein, 678 aa, Homo sapiens
AEPVSPPVSERRPRPGRPQPQPRRAPPPVECMRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 744079 - protein, 283 aa, Homo sapiens
MVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 744080 - protein, 633 aa, Homo sapiens; identical to SEQ ID NO: 744072

SEQ ID NO: 744081 - protein, 166 aa, Homo sapiens
SSAPAVISEPLPGPLPQGSLPLLMPRFPCLLSAVAQSRPSCTHTPCSRPAVTSVLAGLSPLASPCMSWRACVSYAPFHTPLPQQPCSRSTCLVHSSLEAGPGGSLRTMPHITLGCVGGRTSGQRPSSRCLCSQEPNGESGARFPPRGCLGSNRYRGLSKPPKQREG

SEQ ID NO: 744082 - protein, 280 aa, Homo sapiens [sequence omitted]

SEQ ID NO: 744083 - protein, 193 aa, Homo sapiens
NIWSRYEAGFTMLSVAALLGARSRPSCRPRPRGCGRAAALVQATVPATPEQPVLDLKRPFLSRELLSGQAVRRPLVASVGLKCSLSSVCYSHTDIKVPDFSEYRRLEVLDSTKSSRESSEARERFLLFGNLEYLLWGVAYAAKNAVTQFVSSMSASADVLALAKIEIKLSDIPEGKNMAFKWRGKPLFVRHRT

SEQ ID NO: 744084 - protein, 163 aa, Homo sapiens
GCRVVGSSPLRFAPLSATPEQPVLDLKRPFLSRELLSGQAVRRPLVASVGLKCSLSSVCYSHTDIKVPDFSEYRRLEVLDSTKSSRESSEARERFLLFGNWEELLWGVAYAAKNAVTQFVSSMSASADVLALAKIEIKLSDIPEGKNMAFKWRGKPLFVRHRT

SEQ ID NO: 744085 - protein, 431 aa, Homo sapiens
AGSQRVFEAASAATMSGRSRGRKSSRAKNRGKGRAKARVRPAPDDAPRDPDPSQYQSLGEDTQAAQVQAGAGWGGLEAAASAQLLRLGEEAACRLPLDCGLALRARAAGDHGQAAARPGPGKAASLSERLAADTVFVGTAGTVGRPKNAPRVGNRRGPAGKKAPETCSTAGRGPQVIAGGRQKKGAAGENTSVSAGEEKKEERDAGSGPPATEGSMDTLENVQLKLENMNAQADRAYLRLSRKFGQLRLQHLERRNHLIQNIPGFWGQAFQNHPQLASFLNSQEKEVLSYLNSLEVEELGLARLGYKIKFYFDRNPYFQNKVLIKEYGCGPSGQVVSRSTPIQWLPGHDLQSLSQGNPENNRSFFGWFSNHSSIESDKIVEIINEELWPNPLQFYLLSEGARVEKGKEKEGRQGPGKQPMETTQPGVSQSN

SEQ ID NO: 744086 - protein, 283 aa, Homo sapiens
AGSQRVFEAASAATMSGRSRGRKSSRAKNRGKGRAKARVRPAPDDAPRDPDPSQYQSLGEDTQAAQVQAGAGWGGLEAAASAQLLRLGEEAACRLPLDCGLALRARAAGDHGQAAARPGPGKAASLSERLAADTVFVGTAGTVGRPKNAPRVGNRRGPAGKKAPETCSTAGRGPQVIAGGRQKKGAAGENTSVSAGEEKKEERDAGSGPPATEGSMDTLENVQLKLENMNAQADRAYLRLSRKFGQLRLQHLERRNHLIQTDGRAGMCGHVFTVIMLWLQLGR

SEQ ID NO: 744087 - protein, 431 aa, Homo sapiens; identical to SEQ ID NO: 744085

SEQ ID NO: 744088 - protein, 453 aa, Homo sapiens
AGSQRVFEAASAATMSGRSRGRKSSRAKNRGKGRAKARVRPAPDDAPRDPDPSQYQSLGEDTQAAQVQAGAGWGGLEAAASAQLLRLGEEAACRLPLDCGLALRARAAGDHGQAAARPGPGKAASLSERLAADTVFVGTAGTVGRPKNAPRVGNRRGPAGKKAPETCSTAGRGPQVIAGGRQKKGAAGENTSVSAGEEKKEERDAGSGPPATEGSMDTLENVQLKLENMNAQADRAYLRLSRKFGQLRLQHLERRNHLIQNIPGFWGQAFQNHPQLASFLNSQEKEVLSYLNSLEVEELGLARLGYKIKFYFDRNPYFQNKVLIKEYGCGPSGQVVSRSTPIQWLPGHDLQSLSQGNPENNRSFFGWFSNHSSIESDKIVEIINEELWPNPLQFYLLSEGARVEKGKEKEGRQGPGKQPMETTQPGGPDPASLSSFFSSPADTEVFSPAAPLI

SEQ ID NO: 744089 - protein, 37 aa, Homo sapiens
CVDWFPCWKVWMIISISVWQEENEVMCVMMRPSTWHT

SEQ ID NO: 744090 - protein, 782 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 744091 - protein, 682 aa, Homo sapiens
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 744092 - protein, 782 aa, Homo sapiens; identical to SEQ ID NO: 744090

SEQ ID NO: 744093 - protein, 682 aa, Homo sapiens; identical to SEQ ID NO: 744091

SEQ ID NO: 744094 - protein, 717 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 744095 - protein, 542 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILK

SEQ ID NO: 744096 - protein, 542 aa, Homo sapiens; identical to SEQ ID NO: 744095

SEQ ID NO: 744097 - protein, 782 aa, Homo sapiens; identical to SEQ ID NO: 744090

SEQ ID NO: 744098 - protein, 983 aa, Homo sapiens
GRAGHHPPRDWYRSPQLQGTQRRQGLQGRGEGGLSLLKGNSGPQTSKPGHCSEVPPRKAKRSPTALTPGNQPRHSTPHQQATPRASRTHARTHTRLSRLPALRSVMLYCAYLGAGEERRLTRRQRPERGGKSSPRPAGRPKLLARHFRWGRSGAGLSGWRPTAAPVFVLEAQLMQAGWSGRHCRERASRRCSPSDCGLHPDCLLLQGLHDYLKFNNNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 744099 - protein, 782 aa, Homo sapiens; identical to SEQ ID NO: 744090

SEQ ID NO: 744100 - protein, 193 aa, Homo sapiens
GRAGHHPPRDWYRSPQLQGTQRRQGLQGRGEGGLSLLKGNSGPQTSKPGHCSEVPPRKAKRSPTALTPGNQPRHSTPHQQATPRASRTHARTHTRLSRLPALRSVMLYCAYLGAGEERRLTRRQRPERGGKSSPRPAGRPKLLARHFRWGRSGAGLSGWRPSCCASVCVGSSADAGRLEWTSLPGTSESPLQP

SEQ ID NO: 744101 - protein, 542 aa, Homo sapiens; identical to SEQ ID NO: 744095

SEQ ID NO: 744102 - protein, 193 aa, Homo sapiens; identical to SEQ ID NO: 744100

SEQ ID NO: 744103 - protein, 700 aa, Homo sapiens
GVRGLLASLFAFNSFRENWQRAWVRALNEQACRNGSSIQIAFEEVPQLPPRASISHVTCVDQSEHTMVLRCQLSAEEVRFPVSVTQQSPAAVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVEVEKLTPGVGGRTQGMGSLRGSVSSLSTPGQLHYEEGSPRNLGTPTSSTPRPSITPTKKIELDRTIMPDGTIVTTVTTVQSRPRIDGKLDSPSRSPSKVEVTEKTTTVLSESSGPSNTSHSSSREWGMGCMSVGWPWCPSIKKYSGWDRRSSNPRKSQGEVRLFILCTPAGDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 744104 - protein, 668 aa, Homo sapiens
GVRGLLASLFAFNSFRENWQRAWVRALNEQACRNGVLRCQLSAEEVRFPVSVTQQSPAAVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVEVEKLTPGEVGGHRGWAVSEALSLLSPTPGQLHYEEGSPRNLGTPTSSTPRPSITPTKKIELDRTIMPDGTIVTTVTTVQSRPRIDGKLDSPSRSPSKVEVTEKTTTVLSESSGPSNTSHSSSREWGMGCMSVGWPWCPSIKKYSGWDRRSSNPRKSQGEVRLFILCTPAGDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 744105 - protein, 623 aa, Homo sapiens
GVRGLLASLFAFNSFRENWQRAWVRALNEQACRNGSSIQIAFEEVPQLPPRASISHVTCVDQSEHTMVLRCQLSAEEVRFPVSVTQQSPAAVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 744106 - protein, 417 aa, Homo sapiens
KARYEAGCESAEAERTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 744107 - protein, 355 aa, Homo sapiens
AQLTVPSLSPAELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 744108 - protein, 306 aa, Homo sapiens
KARYEAGVNRPRRSLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 744109 - protein, 547 aa, Homo sapiens
GVRGLLASLFAFNSFRENWQRAWVRALNEQACRNGSSIQIAFEEVPQLPPRASISHVTCVDQSEHTMVLRCQLSAEEVRFPVSVTQQSPAAVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDTACSGRNALCQRPTKKRDLSLVLQTAADPKKGQAIGEGTKKGTHKTPVLRG

SEQ ID NO: 744110 - protein, 538 aa, Homo sapiens
GVRGLLASLFAFNSFRENWQRAWVRALNEQACRNGSSIQIAFEEVPQLPPRASISHVTCVDQSEHTMVLRCQLSAEEVRFPVSVTQQSPAAVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETIQQAQEVDAAANLVVVGG

SEQ ID NO: 744111 - protein, 205 aa, Homo sapiens
MALQLSREQGITLRGSAEIVAEFFSFGINSILYQRGIYPSETFTRVQKYGLTLLVTTDLELIKYLNNVVEQLKDWLYKCSVQKLVVVISNIESGEVLERWQFDIECDKTAKDDSAPREKSQKAIQDEIRSVIRQITATVTFLPLLEVSCSFDLLIYTDKDLVVPEKWEESGPQFITNSEEVRLRSFTTTIHKVNSMVAYKIPVND

SEQ ID NO: 744112 - protein, 102 aa, Homo sapiens
MRERAGPRCVGLGLKARRACAKDLTTCCVVTFETLGGEVLLEPLWLLSAEWKRVLLFVSLAMALQLSREQGITLRGSAEIVAEFFLHPEKSLRKLSRMKSVQ

SEQ ID NO: 744113 - protein, 205 aa, Homo sapiens; identical to SEQ ID NO: 744111

SEQ ID NO: 744114 - protein, 187 aa, Homo sapiens
MALQLSREQGITLRGSAEIVAEFFSFGINSILYQRGIYPSETFTRVQKYGLTLLVTTDLELIKYLNNVVEQLKDWLYKCSVQKLVVVISNIESGEVLERWQFDIECDKTAKDDSAPREKSQKAIQDEIRSVIRQITATVTFLPLLEVSCSFDLLIYTDKDLVVPDRSFTTTIHKVNSMVAYKIPVND

SEQ ID NO: 744115 - protein, 250 aa, Homo sapiens
HSVETLWRREMLLKTGDESWCPAEMPWLVAFGSVIPGQLELATPASPGRSVLTHVPECRLLSSSLSSSLRDLPAFLYHPWVIYPSETFTRVQKYGLTLLVTTDLELIKYLNNVVEQLKDWLYKCSVQKLVVVISNIESGEVLERWQFDIECDKTAKDDSAPREKSQKAIQDEIRSVIRQITATVTFLPLLEVSCSFDLLIYTDKDLVVPEKWEESGPQFITNSEEVRLRSFTTTIHKVNSMVAYKIPVND

SEQ ID NO: 744116 - protein, 156 aa, Homo sapiens
MALQLSREQGITLRGSAEIVAEFFYWLYKCSVQKLVVVISNIESGEVLERWQFDIECDKTAKDDSAPREKSQKAIQDEIRSVIRQITATVTFLPLLEVSCSFDLLIYTDKDLVVPEKWEESGPQFITNSEEVRLRSFTTTIHKVNSMVAYKIPVND

SEQ ID NO: 744117 - protein, 142 aa, Homo sapiens
MGLGLKARRACAKDLTTCCVVTFETLGGEVLLEPLWLLSAEWKRVLLFVSLAMALQLSREQGITLRGSAEIVAEFFSFGINSILYQRGIYPSETFTRVQKYGLTLLVTTDLELIKYLNNVVEQLKVHPEKSLRKLSRMKSVQ

SEQ ID NO: 744118 - protein, 62 aa, Homo sapiens
LAEKGTLLPAGSQAPELASHWATPSLDWVLSAQPFTRALPRDRSQGPQMPPSANCSFCPEDM

SEQ ID NO: 744119 - protein, 93 aa, Homo sapiens
LGLERRVPGPSYQRSAGSGPAARVLLGSQGHGWVNGLTAGLLAQQTLSSPMAQSTSSLQGQLEGRGTTRPSLQLALPLQLRGGLNYRTHSQDP

SEQ ID NO: 744120 - protein, 73 aa, Homo sapiens
ERFAGSDAELCAREAWPTLCSAQVAAWFFATLAAVAESLIPVPGAPRLVHAARHAGFTTVLLATPEPPRRLND

SEQ ID NO: 744121 - protein, 438 aa, Homo sapiens
MASAVWGSAPWWGPPPPAPARPLTDIDFCSGAQLQELTQLIQELGVQESWSDGPKPGADLLRAKDFVFSLLGLVHRRDPRFPPQAELLLLRGGIREGSLDLGHAPLGPYARGPHYDAGFTLLVPMFSLDGTELQLDLESCYAQVCLPEMVCGTPIREMWQDCLGPPVPGARDSIHRTESEESSKDWQSSVDQPHSYVTEHEAPVSLEKSPSDVSASESPQHDVVDLGSTAPLKTMSSDVTKAAVESPVPKPSEAREAWPTLCSAQVAAWFFATLAAVAESLIPVPGAPRLVHAARHAGFTTVLLATPEPPRRLLLFDLIPVGVRGGLARGGFGATRGPVRWPLSRLPSTWCPVAAPSGRAPPPGSSVLPARSWRSKRAYQRRCCRRTRRPRRYCARWWPGPGRRRPTSCGRCCTGRASGCLRSTWRGQKMRAPAASGC

SEQ ID NO: 744122 - protein, 482 aa, Homo sapiens
MASAVWGSAPWWGPPPPAPARPLTDIDFCSGAQLQELTQLIQELGVQESWSDGPKPGADLLRAKDFVFSLLGLVHRRDPRFPPQAELLLLRGGIREGSLDLGHAPLGPYARGPHYDAGFTLLVPMFSLDGTELQLDLESCYAQVCLPEMVCGTPIREMWQDCLGPPVPGARDSIHRTESEESSKDWQSSVDQPHSYVTEHEAPVSLEKSPSDVSASESPQHDVVDLGSTAPLKTMSSDVTKAAVESPVPKPSEAREAWPTLCSAQVAAWFFATLAAVAESLIPVPGAPRLVHAARHAGFTTVLLVRSHSWAGPLASESASFYLVPGGGTERPCASAWQLCFARQELALKARIPAPLLQAHAAAQALLRPLVAGTRAAAPYLLRTLLYWACERLPALYLARPENAGACCLGLLDELGRVLEAGTLPHYFLNGRQLRTGDDSAALLGELARLRGDPARALRAAVEEAKVARKGGGLAGVGGGGT

SEQ ID NO: 744123 - protein, 508 aa, Homo sapiens
MASAVWGSAPWWGPPPPAPARPLTDIDFCSGAQLQELTQLIQELGVQESWSDGPKPGADLLRAKDFVFSLLGLVHRRDPRFPPQAELLLLRGGIREGSLDLGHAPLGPYARGPHYDAGFTLLVPMFSLDGTELQLDLESCYAQVCLPEMVCGTPIREMWQDCLGPPVPGARDSIHRTESEESSKDWQSSVDQPHSYVTEHEAPVSLEKSPSDVSASESPQHDVVDLGSTAPLKTMSSDVTKAAVESPVPKPSEAREAWPTLCSAQVAAWFFATLAAVAESLIPVPGAPRLVHAARHAGFTTVLLATPEPPRRLLLFDLIPVGVRGGLARGARSHSWAGPLASESASFYLVPGGGTERPCASAWQLCFARQELALKARIPAPLLQAHAAAQALLRPLVAGTRAAAPYLLRTLLYWACERLPALYLARPENAGACCLGLLDELGRVLEAGTLPHYFLNGRQLRTGDDSAALLGELARLRGDPARALRAAVEEAKVARKGGGLAGVGGGAH

SEQ ID NO: 744124 - protein, 314 aa, Homo sapiens
MFSLDGTELQLDLESCYAQVCLPEMVCGTPIREMWQDCLGPPVPGARDSIHRTESEESSKDWQSSVDQPHSYVTEHEAPVSLEKSPSDVSASESPQHDVVDLGSTAPLKTMSSDVTKAAVESPVPKPSEAREAWPTLCSAQVAAWFFATLAAVAESLIPVPGAPRLVHAARHAGFTTVLLATPEPPRRLLLFDLIPVGVRGGLARGGFGATRGPVRWPLSRLPSTWCPVAAPSGRAPPPGSSVLPARSWRSKRAYQRRCCRRTRRPRRYCARWWPGPGRRRPTSCGRCCTGRASGCLRSTWRGQKMRAPAASGC

SEQ ID NO: 744125 - protein, 224 aa, Homo sapiens
MASAVWGSAPWWGPPPPAPARPLTDIDFCSGAQLQELTQLIQELGVQESWSDGPKPGADLLRAKDFVFSLLGLVHRRDPRFPPQAELLLLRGGIREGSLDLGHAPLGPYARGPHYDAGFTLLVPMFSLDGTELQLDLESCYAQVCLPEMVCGTPIREMWQDCLGPPVPGARDSIHRTESEESSKDWQSSVDQPHSYVTEHEAPVSLEKSPSDVSASESPAASGC

SEQ ID NO: 744126 - protein, 59 aa, Homo sapiens
SVLVMGRIPVGKKSNRKEVAAGPGFSCFLCMCQELESRSIAQAEVQWHGLRSLQAPPPG

SEQ ID NO: 744127 - protein, 66 aa, Homo sapiens
RFRTVAMESGVAAAIPGQSVPSAKSRTGNILSGPVTRLALSTSSRPLSALGLRFLSFQVKGFDLAF

SEQ ID NO: 744128 - protein, 119 aa, Homo sapiens
TDAFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 744129 - protein, 655 aa, Homo sapiens
MAKGGEALPQGSPAPVQDPHLIKVTVKTPKDKEDFSVTDTCTIQQLKEEISQRFKAHPDQLVLIFAGKILKDPDSLAQCGVRDGLTVHLVIKRQHRAMGNECPAASVPTQGPSPGSLPQPSSIYPADGPPAFSLGLLTGLSRLGLAYRGFPDQPSSLMRQHVSVPEFVTQLIDDPFIPGLLSNTGLVRQLVLDNPHMQQLIQHNPEIGHILNNPEIMRQTLEFLRNPAMMQEMIRSQDRVLSNLESIPGGYNVLCTMYTDIMDPMLNAVQEQFGGNPFATATTDNATTTTSQPSRMENCDPLPNPWTSTHGGSGSRQGRQDGDQDAPDIRNRFPNFLGIIRLYDYLQQLHENPQSLGTYLQGTASALSQSQEPPPSVNRVPPSSPSSQEPGSGQPLPEESVAIKGRSSCPAFLRYPTENSTGQGGDQDGAGKSSTGHSTNLPDLVSGLGDSANRVPFAPLSFSPTAAIPGIPEPPWLPSPAYPRSLRPDGMNPAPQLQDEIQPQLPLLMHLQAAMANPRALQALRQIEQGLQVLATEAPRLLLWFMPCLAGTGSVAGGIESREDPLMSEDPLPNPPPEVFPALDSAELGFLSPPFLHMLQDLVSTNPQQLQPEAHFQVQLEQLRSMGFLNREANLQALIATGGDVDAAVEKLRQS

SEQ ID NO: 744130 - protein, 655 aa, Homo sapiens; identical to SEQ ID NO: 744129

SEQ ID NO: 744131 - protein, 101 aa, Homo sapiens
FFLRDEVSLCCPGWSQTPGLKPSSHFSLPKGAAFLIYLISYEQAIGTAPFLFHKELCPLREGHRCWDPTAWDSESQALTYQLCGLGKVTLSEPWFSHLENR

SEQ ID NO: 744132 - protein, 70 aa, Homo sapiens
TWARQPRGQSPRGGRGVVCGQKVNPEGTVSGEGGQPRAGTLQRPVHPSLCCATGGVRTTGPTSQLQTQGH

SEQ ID NO: 744133 - protein, 388 aa, Homo sapiens
EKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 744134 - protein, 531 aa, Homo sapiens
TRANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 744135 - protein, 531 aa, Homo sapiens; identical to SEQ ID NO: 744134

SEQ ID NO: 744136 - protein, 402 aa, Homo sapiens
TRANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 744137 - protein, 531 aa, Homo sapiens; identical to SEQ ID NO: 744134

SEQ ID NO: 744138 - protein, 404 aa, Homo sapiens
MRFFTSVACYGSCLFASELLIRCKDWLKGRPALFTALLACVLYLCEWTGAKHVPGSSYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 744139 - protein, 214 aa, Homo sapiens
HASRTRGSTHASGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 744140 - protein, 531 aa, Homo sapiens; identical to SEQ ID NO: 744134

SEQ ID NO: 744141 - protein, 531 aa, Homo sapiens; identical to SEQ ID NO: 744134

SEQ ID NO: 744142 - protein, 531 aa, Homo sapiens; identical to SEQ ID NO: 744134

SEQ ID NO: 744143 - protein, 513 aa, Homo sapiens
TRANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEVRAGTPPHLSCPRGRFIARDRNPGERSQAQKVIYYRIPFI

SEQ ID NO: 744144 - protein, 650 aa, Homo sapiens
DFYTVETITSGSSCKCACVAPPSALNPCEGDFRLQKLREADSQDLKLSTIIDMLEGAFYGLDLLKLHSVTTKLVGRVDKLEEEVSKNLTKENEQIKEDMEEIRTEMNKRGKENCSENILDSMPDIRSALQRDAAAAYAHPEYEERFLQEETVSQQINSIELLQTRPLALPEVVKSQRPLQRQVHLRGRPASQPTVIRGITYYKAKVSEEENDIEEQQDEFFSGDNGVDLLIEDQLLRHNGLMTSVTRRPAATRQGHSTAVTSDLNARTAPWSSALPQPSTSDPSIANHASVGPTLQTTSVSPDPTRESVLQPSPQVPATTVAHTATQQPAAPAPPAVSPREALMEAMHTVPVPPTTVRTDSLGKDAPAGRGTTPASPTLSPEEEDDIRNVIGRCKDTLSTITGPTTQNTYGRNEGAWMKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 744145 - protein, 462 aa, Homo sapiens
MPVPASTFSVIPYYKAKVSEEENDIEEQQDEFFSGDNGVDLLIEDQLLRHNGLMTSVTRRPAATRQGHSTAVTSDLNARTAPWSSALPQPSTSDPSIANHASVGPTLQTTSVSPDPTRESVLQPSPQVPATTVAHTATQQPAAPAPPAVSPREALMEAMHTVPVPPTTVRTDSLGKDAPAGRGTTPASPTLSPEEEDDIRNVIGRCKDTLSTITGPTTQNTYGRNEGAWMKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 744146 - protein, 233 aa, Homo sapiens
MKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 744147 - protein, 185 aa, Homo sapiens
MYYMAIIDQAFPSSVPQIITVIKCCHNERHGDIAEEMTVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 744148 - protein, 70 aa, Homo sapiens
RVLAVLVEPGLEGILGVPDFDAFSNTQIVPRLLFENEYSYTTQIDYNPKDRLLYAWDNGHQVTYHVIFAY

SEQ ID NO: 744149 - protein, 650 aa, Homo sapiens; identical to SEQ ID NO: 744144

SEQ ID NO: 744150 - protein, 650 aa, Homo sapiens; identical to SEQ ID NO: 744144

SEQ ID NO: 744151 - protein, 68 aa, Homo sapiens
RIFSEGICQYLWQLGASCPSLSSSGTPNLSTVVSMEEPSLRVRGMLTLTSKEGIISLKKGNIVLNPTT

SEQ ID NO: 744152 - protein, 623 aa, Homo sapiens
QYLKILTSLAEVATTNGHKLLSLSSNYDAQMKSLLRIVRMFCHVFRIGPSSPSNGIDMGYNGNKTPRSQVFKPLELLWHSLDEWLVLIATELMKNKRDSTEITSILLKQKGQDQDAASIPPFEPPGPGSYENLSTGTRESKPDALAGRQEASADCQDVISMTANRLSAVIQAFYMCCSCQMPPGMTSPRFIEFVCKHDEVLKCFVNRNPKIIFDHFHFLLECPELMSRFMHIIKAQPFKDRCEWFYEHLHSGQPDSDMVHRPVNENDILLVHRDSIFRSSCEVVSKANCAKLKQGIAVRFHGEEGMGQGVVREWFDILSNEIVNPDYALFTQSADGTTFQPNSNSYVNPDHLNYFRFAGQILGLALNHRQLVNIYFTRSFYKHILGIPVNYQDVASIDPEYAKNLQWILDNDISDLGLELTFSVETDVFGAMEEVPLKPGGGSILVTQNNKAEYVQLVTELRMTRAIQPQINAFLQGFHMFIPPSLIQLFDEYELELLLSGMPEIDVSDWIKNTEYTSGYEREDPVIQWFWEVVEDITQEERVLLLQFVTGSSRVPHGGFANIMGGSGLQNFTIAAVPYTPNLLPTSSTCINMLKLPEYPSKEILKDRLLVALHCGSYGYTMA

SEQ ID NO: 744153 - protein, 623 aa, Homo sapiens; identical to SEQ ID NO: 744152

SEQ ID NO: 744154 - protein, 94 aa, Homo sapiens
GITNWYDERCKNPSVILDDSLLVEEKSYGSGDICSLEFIHAHKMHSPVGQGVTASLKLIIQVSSTVVLCYCHLIPSMMSYVGSVIQLEALVLSQ

SEQ ID NO: 744155 - protein, 102 aa, Homo sapiens
MFTYSVPKPALGLVTIFFFSLELRWCENIHKCVKINSVTQDLLCRPSRPVAIATPTWFLPSQPWEATCSSHPSNRAGTWRGVGVRDSPGAGQRGPAGRLGSQ

SEQ ID NO: 744156 - protein, 924 aa, Homo sapiens
NLCSLIIPLREVTIVEKADSSSVLPSPLSISTRNRMTFLFANLKDRDFLVQRISDFLQQTTSKIYSDKEFAGSYNSSDDEVYSRPSSLVSSSPQRSTSSDADGERQFNLNGNSVPTATQTLMTMYRRRSPEEFNPKLAKEFLKEQAWKIHFAEYGQGICMYRTEKTRELVLKGIPESMRGELWLLLSGAINEKATHPGYYEDLVEKSMGKYNLATEEIERDLHRSLPEHPAFQNEMGIAALRRVLTAYAFRNPNIGYCQAMNIVTSVLLLYAKEEEAFWLLVALCERMLPDYYNTRVVGALVDQGVFEELARDYVPQLYDCMQDLGVISTISLSWFLTLFLSVMPFESAVVVVDCFFYEGIKVIFQLALAVLDANVDKLLNCKDDGEAMTVLGRYLDSVTNKDSTLPPIPHLHSLLSDDVEPYPEVDIFRLIRTSYEKFGTIRADLIEQMRFKQRLKVIQTLEDTTKRNVVRTIVTETSFTIDELEELYALFKAEHLTSCYWGGSSNALDRHDPSLPYLEQYRIDFEQFKGMFALLFPWACGTHSDVLASRLFQLLDENGDSLINFREFVSGLSAACHGDLTEKLKLLYKMHVLPEPSSDQDEPDSAFEATQYFFEDITPECTHVVGLDSRSKQGADDGFVTVSLKPDKGKRANSQENRNYLRLWTPENKSKSKNAKDLPKLNQGQFIELCKTMYNMFSEDPNEQELYHATAAVTSLLLEIGEVGKLFVAQPAKEGGSGGSGPSCHQGIPGVLFPKKGPGQPYVVESVEPLPASLAPDSEEHSLGGQMEDIKLEDSSPRDNGACSSMLISDDDTKDDSSMSSYSVLSAGSHEEDKLHCEDIGEDTVLVRSGQGTAALPRSTSLDRDWAITFEQFLASLLTEPALVKYFDKPVCMMARITSAKNIRMMGKPLTSASDYEISAMSG

SEQ ID NO: 744157 - protein, 924 aa, Homo sapiens; identical to SEQ ID NO: 744156

SEQ ID NO: 744158 - protein, 194 aa, Homo sapiens
NLCSLIIPLREVTIVEKADSSSVLPSPLSISTRNRMTFLFANLKDRDFLVQRISDFLQQTTSKIYSDKEFAGSYNSSDDEVYSRPSSLVSSSPQRSTSSDADGERQFNLNGNSVPTATQTLMTMYRRRSPEEFNPKLAKEFLKEQAWKIHFAEYGQGICMYRTEKTRELVLKGIPESMRGELWLLLSGTAAGLG

SEQ ID NO: 744159 - protein, 924 aa, Homo sapiens; identical to SEQ ID NO: 744156

SEQ ID NO: 744160 - protein, 924 aa, Homo sapiens; identical to SEQ ID NO: 744156

SEQ ID NO: 744161 - protein, 326 aa, Homo sapiens
MASKVSCLYVLTVVCWASALWYLSITRPTSSYTGSKPFSHLTVARKNFTFGNIRTRPINPHSFEFLINEPNKCEKNIPFLVILISTTHKEFDARQAIRETWGDENNFKGIKIATLFLLGKNADPVLNQMVEQESQIFHDIIVEDFIDSYHNLTLKTLMGMRWVATFCSKAKYVMKTDSDIFVNMDNLIYKLLKPSTKPRRRYFTGYVINGGPIRDVRSKWYMPRDLYPDSNYPPFCSGTGYIFSADVAELIYKTSLHTRLLHLEDVYVGLCLRKLGIHPFQNSGFNHWKMAYSLCRYRRVITVHQISPEEMHRIWNDMSSKKHLRC

SEQ ID NO: 744162 - protein, 81 aa, Homo sapiens
PRSADRSFSSRFAWSTLPLSEGDLAPWLPALSSLMCAILPGLCLVLREAIREATAGLEVCLSVSTSGLLVHLLYLEVIQAH

SEQ ID NO: 744163 - protein, 133 aa, Homo sapiens [sequence omitted]

SEQ ID NO: 744164 - protein, 194 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILCAADQDWRLLWGGHQQGVRNGGFTTLSGWYYKGTLLLRS

SEQ ID NO: 744165 - protein, 145 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPELLFQLIPFPGTV

SEQ ID NO: 744166 - protein, 315 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTVLLLLLQPQLRLKPRKSRRSRTRIWDWSL

SEQ ID NO: 744167 - protein, 315 aa, Homo sapiens; identical to SEQ ID NO: 744166

SEQ ID NO: 744168 - protein, 315 aa, Homo sapiens; identical to SEQ ID NO: 744166

SEQ ID NO: 744169 - protein, 339 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVIAQAPYTSESYDQVQLDPWLLVSAARMYFAPPPALVVPAAPVKVQSKKEYYHPSHRIWSRSCPRPTSAPPHHLWTLESGINAVCLI

SEQ ID NO: 744170 - protein, 253 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILGVRNVASVCLQIGYPTVASVPHSIINGYKRVLALSVETDYTFPLAEKVKAFLADPSAFVAAAPVAAATTVLLLLLQPQLRLKPRKSRRSRTRIWDWSL

SEQ ID NO: 744171 - protein, 244 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEQGLAWQIGLSQLVCIRSPHSIYSGTRP

SEQ ID NO: 744172 - protein, 297 aa, Homo sapiens
MPREDRATWKSNYFLKIIQLLDDYPKCFIVGADNVGSKQMQQIRMSLRGKAVVLMGKNTMMRKAIRGHLVVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTVLLLLLQPQLRLKPRKSRRSRTRIWDWSL

SEQ ID NO: 744173 - protein, 197 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILCELIRRRRGSRKHAVQCHIPPFLGCITGRRQINLICSGNYSV

SEQ ID NO: 744174 - protein, 154 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCVDCQLAIHAWPAIHAWRTSALSTFDGSRRAYHAWL

SEQ ID NO: 744175 - protein, 134 aa, Homo sapiens
MPREDRATWKSNYFLKIIQLLDDYPKCFIVGADNVGSKQMQQIRMSLRGKAVVLMGKNTMMRKAIRGHLENNPALENCCLISGDVGFVSTKEAYLDQGHFLAIVPPLRLPIPCKYFPPDIVGQSSFQVGTNSGH

SEQ ID NO: 744176 - protein, 105 aa, Homo sapiens
MPREDRATWKSNYFLKIIQLLDDYPKCFIVGADNVGSKQMQQIRMSLRGKAVVLMGKNTMMLANKVQLLPCWCIAHVGTFSQTLFGPEDLFSGSGYTEFRDIESR

SEQ ID NO: 744177 - protein, 231 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEVPNVAVLLRCYHCA

SEQ ID NO: 744178 - protein, 241 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILCAADQDWRPQWGGREAAGGLVIFPFPLGRASAGVPRWRLTLGCVPGNGFLRGGPGPLRSVPRVAPLRETARWEPLECPLARDGSRI

SEQ ID NO: 744179 - protein, 315 aa, Homo sapiens; identical to SEQ ID NO: 744166

SEQ ID NO: 744180 - protein, 315 aa, Homo sapiens; identical to SEQ ID NO: 744166

SEQ ID NO: 744181 - protein, 325 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTVLLLLLQPQLRLKPSKTLTTPTPRLPSFASPPLLKAPFL

SEQ ID NO: 744182 - protein, 263 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLERVSVLEGPQCRVVALSPVVSHYTGTCGLREPLVGRLSLGAGGLLCA

SEQ ID NO: 744183 - protein, 183 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITNWRQSGSQRSHAAEHAQHLPLLLWAGHPAGVRQWQHLQP

SEQ ID NO: 744184 - protein, 198 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILCEDDKWRKSGSKRSKDDENVKNFPLILWDGNKEGVRKWKNIKT

SEQ ID NO: 744185 - protein, 183 aa, Homo sapiens; identical to SEQ ID NO: 744183

SEQ ID NO: 744186 - protein, 164 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAVGSSFRYHTKISDDVQLIKTGDFFGVVTNKGFAMEDLQP

SEQ ID NO: 744187 - protein, 298 aa, Homo sapiens
MSVASVFVGPPQTRGPHVRTPMTFPPRVIWGCTAQHDHGGRKRSGTSRLQVPVSACAPSRFGRRPREPGALRRTDLRGCLKAEAKMAVLSAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGCPPTAEALLYGILQLQRKIKRERRLQIWYRR

SEQ ID NO: 744188 - protein, 298 aa, Homo sapiens; identical to SEQ ID NO: 744187

SEQ ID NO: 744189 - protein, 335 aa, Homo sapiens
MTRGSTHASMAVLSAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPVQTNGASCECGCTPPSLQTELLPPWGPRSSLPADCAPCLGTALLPPWGPCSSLPPCGPRSSLPGDRAPPSLRTALGPPWGPRPSLPADRAPPSLGTSLLPPSLRTVLLPPCGLCFSLPWSSLDLPELCQVGPGRPFPGPAVALSF

SEQ ID NO: 744190 - protein, 103 aa, Homo sapiens
PLTRVPSPGSSSVGLAVQARGVHQSVATDGPSSTQPALPKARAVAPKPSSRGEYVVAKLDDLVNWARRVSTMSCRPSSSARASLHTHRHTHTHTNVQTRTHTT

SEQ ID NO: 744191 - protein, 284 aa, Homo sapiens
MRSEPLWAAAPGTRSAKENGPQRLSEGRGQDGGAVRWSLPLSPKLECSGAASAHCNLYLPGSSDSPASASRVAGITAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGCPPTAEALLYGILQLQRKIKRERRLQIWYRR

SEQ ID NO: 744192 - protein, 222 aa, Homo sapiens
MTRGSTHASMAVLSAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGCPPTAEALLYGILQLQRKIKRERRLQIWYRR

SEQ ID NO: 744193 - protein, 214 aa, Homo sapiens
PSGRAAAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGCPPTAEALLYGILQLQRKIKRERRLQIWYRR

SEQ ID NO: 744194 - protein, 291 aa, Homo sapiens
MSVASVFVGPPQTRGPHVRTPMTFPPRVIWGCTAQHDHGGRKRSGTSRLQVPVSACAPSRFGRRPREPGALRRTDLRGCLKAEAKMAVLSAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGRAGTAPPTRELETGPAPHGARRPL

SEQ ID NO: 744195 - protein, 217 aa, Homo sapiens
QLYARITGSRQMAVLSAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGRAGTAPPTRELETGPAPHGARRPL

SEQ ID NO: 744196 - protein, 267 aa, Homo sapiens
MSVASVFVGPPQTRGPHVRTPMTFPPRVIWGCTAQHDHGGRKRSGTSRLQVPVSACAPSRFGRRPREPGALRRTDLRGCLKAEAKMAVLSAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPD

SEQ ID NO: 744197 - protein, 252 aa, Homo sapiens
MTRGSTHASMAVLSAPGLRGFRILGLRSSVGLAVQARGVHQSVATDGPSRPLAAAVGARIRLWEAPAWLTPPVPVCLCASTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGCPPTAEALLYGILQLQRKIKRERRLQIWYRR

SEQ ID NO: 744198 - protein, 237 aa, Homo sapiens
PSGRAAAPGLRGFRILGLRSSVGLAVQARGVHQSVATDGPSRPLAAAVGARIRLWEAPAWLTPPVPVCLCASTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGRAGTAPPTRELETGPAPHGARRPL

SEQ ID NO: 744199 - protein, 84 aa, Homo sapiens
IQGHQTLALAPGGCPQPLHRASPHPQRQSTITWAASTEADCSHSSGGWKAKIGGQQGWFLLRPLSLACPWPSSPCVFPLYMFVS

SEQ ID NO: 744200 - protein, 79 aa, Homo sapiens
MGQGGGHTSQSLTSCGSRPLAAAVGARIRLWEAPAWLTPPVPVCLCASTQPALPKARAVAPKPSSRGEYVVAKLDDLVN

SEQ ID NO: 744201 - protein, 132 aa, Homo sapiens [sequence omitted]

SEQ ID NO: 744202 - protein, 132 aa, Homo sapiens [sequence omitted]

SEQ ID NO: 744203 - protein, 132 aa, Homo sapiens [sequence omitted]

SEQ ID NO: 744204 - protein, 410 aa, Homo sapiens
DLAVEMHEPYTFLNGLTVADMEDLLEDIQVYMELEQGKNADFWRDMTTITEDEISKLRKLEASGKGPGHRGQNPRWWPQPGHGLLGEPPAAASCPHGTGPVSTRLRERHQDVLRQKLYKLKQEQGVESEPLFPILKQEPQSPSRSLEPEDAAPTPPGPSSEGGPAEAEVDGATPTEGDGDGDGEGEGEGEAVLMEEDLIQQSLDDYDAGRYSPRLLTAHELPLDAHVLEPDEDLQRLQLSRQQLQVTGDASESAEDIFFRRAKEGMGQDEAQFSVEMPLTGKAYLWADKYRPRKPRFFNRVHTGFEWNKYNQTHYDFDNPPPKIVQGYKFNIFYPDLIDKRSTPEYFLEACADNKDFAILRFHAGPPYEDIAFKIVNREWEYSHRHGFRCQFANGIFQLWFHFKRYRYRR

SEQ ID NO: 744205 - protein, 441 aa, Homo sapiens
DLAVEMHEPYTFLNGLTVADMEDLLEDIQVYMELEQGKNADFWRDMTTITEDEISKLRKLEASGKGPGERREGVNASVSSDVQSVFKGKTYNQLQVIFQGIEGKIRAGGPNLDMGYWESLLQQLRAHMAGPGEHRLRERHQDVLRQKLYKLKQEQGVESEPLFPILKQEPQSPSRSLEPEDAAPTPPGPSSEGGPAEAEVDGATPTEGDGDGDGEGEGEGEAVLMEEDLIQQSLDDYDAGRYSPRLLTAHELPLDAHVLEPDEDLQRLQLSRQQLQVTGDASESAEDIFFRRAKEGMGQDEAQFSVEMPLTGKAYLWADKYRPRKPRFFNRVHTGFEWNKYNQTHYDFDNPPPKIVQGYKFNIFYPDLIDKRSTPEYFLEACADNKDFAILRFHAGPPYEDIAFKIVNREWEYSHRHGFRCQFANGIFQLWFHFKRYRYRR

SEQ ID NO: 744206 - protein, 441 aa, Homo sapiens; identical to SEQ ID NO: 744205

SEQ ID NO: 744207 - protein, 441 aa, Homo sapiens; identical to SEQ ID NO: 744205

SEQ ID NO: 744208 - protein, 441 aa, Homo sapiens; identical to SEQ ID NO: 744205

SEQ ID NO: 744209 - protein, 441 aa, Homo sapiens; identical to SEQ ID NO: 744205

SEQ ID NO: 744210 - protein, 1228 aa, Homo sapiens
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNSTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 744211 - protein, 970 aa, Homo sapiens
MQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNSTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 744212 - protein, 378 aa, Homo sapiens
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGK

SEQ ID NO: 744213 - protein, 322 aa, Homo sapiens
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPGHRL

SEQ ID NO: 744214 - protein, 208 aa, Homo sapiens
RRSVLEKNLIKVTVAPFNPTVCDALLDKDETDSSKDTEKLSSLGEEMREDGLSPNESKLCTESEGISPNNSAWNGPQLSSSNNNFQQTVSDKNMPDSENPTSVFSRISDHSETPNMELSCRNGGSHKSSCEMRSLVVSTSSNKQDVLNKDSGKMKGHERRLGKVIPVLQTKTRTNVPTFSQSNLEQQKQLYLRSLIAHIEDPEDTNQG

SEQ ID NO: 744215 - protein, 208 aa, Homo sapiens; identical to SEQ ID NO: 744214

SEQ ID NO: 744216 - protein, 334 aa, Homo sapiens
RRVRFSALDLGGSVACSRRETRCRGEPSGRTFQDRNRPSAEKMSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKKKAYYGGIMTFAWATDNDALRHLSTEIIQARFLASGLKCRYYNPAIHTA

SEQ ID NO: 744217 - protein, 331 aa, Homo sapiens
MVRGPRVIGSVACSRRETRCRGEPSGRTFQDRNRPSAEKMSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKKKAYYGGIMTFAWATDNDALRHLSTEIIQARFLASGLKCRYYNPAIHTA

SEQ ID NO: 744218 - protein, 150 aa, Homo sapiens
MHSTRPACYRLRCLLPEGDALPRRTQRVMNPPRFFAQAFPKPPPGLRGFSYWAVVKTRCGDCSSPGLGAAGRESFPLGRFSLLTQEHLQRQLVAEDPGAGRFGTRGELGRRERRRPSAAYILANQTWQHFPTVQEHEGLKGKRRNRGSRG

SEQ ID NO: 744219 - protein, 67 aa, Homo sapiens
QCRDSVCCLAQNGCPNILLEVNGMAVNTKTHPHSAHHHSHCWLAGTLARLGDNMVAGSSLGFDRTSG

SEQ ID NO: 744220 - protein, 693 aa, Homo sapiens
PTKKNAEKYSGILEGPVDRPVLSNYSDTPSGLVNGRKNESEPWQPSLNSEAVYPMNCVPDVITASKAGVSSALPPADVSASIGSSPGVASNLTEPSYSSSTCGSHTVPSLHAGLPSQEYAPGYNGSYLHSTYSSQPAPALPSPHPSPLHSSGLLQPPPPPPPPPALVPGYNGTSNLSSYSYPSASYPPQTAVGSGYSPGGAPPPPSAYLPSGIPAPTPLPPTTVPGYTYQGHGLTPIAPSALTNSSASSLKRKAFYMAGQGDMDSSYGNYSYGQQRSTQSPMYRMPDNSISNTNRGNGFDRSAETSSLAFKPTKQLMSSEQQRKFSSQSSRALTPPSYSTAKNSLGSRSSESFGKYTSPVMSEHGDEHRQLLSHPMQGPGLRAATSSNHSVDEQLKNTDTHLIDLVTNEIITQGPPVDWNDIAGLDLVKAVIKEEVLWPVLRSDAFSGLTALPRSILLFGPRGTGKTLLGRCIASQLGATFFKIAGSGLVAKWLGEAEKIIHASFLVARCRQPSVIFVSDIDMLLSSQVNEEHSPVSRMRTEFLMQLDTVLTSAEDQIVVICATSKPEEIDESLRRYFMKRLLIPLPDSTARHQIIVQLLSQHNYCLNDKEFALLVQRTEGFSGLDVAHLCQEAVVGPLHAMPATDLSAIMPSQLRPVTYQDFENAFCKIQPSISQKELDMYVEWNKMFGCSQ

SEQ ID NO: 744221 - protein, 184 aa, Homo sapiens
VTLPYMNWGNLKLFLRQCKLVEANNPQAISQQDLVHMAIQIACGMSYLARREVIHKDLAARNCVIDDTLQVKITDNANENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 744222 - protein, 194 aa, Homo sapiens
VTLPYMNWGNLKLFLRQCKLVEANNPQAISQQDLVHMAIQIACGMSYLARREVIHKDLAARNCVIDDTLQVKITDNAVSWTITVWGTMKTGQFVGWLLKVWLITSSLALVMCWAFGVTLWELMTLGQTPYVDIDPFEMAAYLKDGYRIAQPINCPDELFAVMACCWALDPEERPKFQQLVQCLTEFHAALGAYV

SEQ ID NO: 744223 - protein, 99 aa, Homo sapiens
LTHLTGDILGETIVGSLTPSEIQQLLRVPTGCPEQTLSSLTPVIILSRYLDTTGQWGKVGVEHRDQVMKNIVSGYTQMLTHRSSDGTYHTSKGNPGSTW

SEQ ID NO: 744224 - protein, 367 aa, Homo sapiens
SSRRLREEIRAGRLALPSHRVLVHRSRRRLPASPAMYRPRARAAPEGRVRGCAVPSTVLLLLAYLAYLALGTGVFWTLEGRAAQDSSRSFQRDKWELLQNFTCLDRPALDSLIRDVVQAYKNGASLLSNTTSMGRWELVGSFFFSVSTITTIGYGNLSPNTMAARLFCIFFALVGIPLNLVVLNRLGHLMQQGVNHWASRLGGTWQDPDKARWLAGSGALLSGLLLFLLLPPLLFSHMEGWSYTEGFYFAFITLSTVGFGDYVIGMNPSQRYPLWYKNMVSLWILFGMAWLALIIKLILSQLETPGRVCSCCHHSSKEDFKSQSWRQGPDREPESHSPQQGCYPEGPMGIIQHLEPSAHAAGCGKDS

SEQ ID NO: 744225 - protein, 211 aa, Homo sapiens
QRLQAGNLENTDQVKSPLLTGDSSGLPPAPSAPTHGVKASGGLGTMLHPQDPDKARWLAGSGALLSGLLLFLLLPPLLFSHMEGWSYTEGFYFAFITLSTVGFGDYVIGMNPSQRYPLWYKNMVSLWILFGMAWLALIIKLILSQLETPGRVCSCCHHSSKEDFKSQSWRQGPDREPESHSPQQGCYPEGPMGIIQHLEPSAHAAGCGKDS

SEQ ID NO: 744226 - protein, 133 aa, Homo sapiens
SYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISVSTFVDLEWGFWLWE

SEQ ID NO: 744227 - protein, 200 aa, Homo sapiens
DPSIVGQDSSPLRREALAAVLYIGPAPGLTGREPRFNQASTPHGGLLPASACRLCSASSGSAAVHLLPCPRCARNSVVLGRLKASHCQETQKEKCQMFNTQLDLGMLTRSSQRCGCPPLPAPCRRRCGLQELGCCQPKGSLHSHSHLSSHQSPSYPLLPLFKTISLKARDLHIPKSIGHFHSLPDLTPNSIKNNSTVLSS

SEQ ID NO: 744228 - protein, 706 aa, Homo sapiens
MDPGWGQRDVGWAALLILFAASLLTVFAWLLQYARGLWLARARGDRGPGPALAGEPAGSLRELGVWRSLLRLRATRAGAAEEPGVRGLLASLFAFKSFRENWQRAWVRALNEQACRNGSSIQIAFEEVPQLPPRASISHVTCVDQSEHTMVLRCQLSAEEVRFPVSVTQQSPAVVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 744229 - protein, 706 aa, Homo sapiens; identical to SEQ ID NO: 744228

SEQ ID NO: 744230 - protein, 101 aa, Homo sapiens
QPICCMNCARCMPKDKAIKKFVIRNIVEPAAVRDIFEARVFNAYVLSKQYMKLHYCVSCAIHSKVVRNQSHEGFKDPTLPPLDLWVLPHDPHQSPCKELSP

SEQ ID NO: 744231 - protein, 322 aa, Homo sapiens
MWRLVPPKLGRLSRSLKLAALGSLLVLMVLHSPSLLASWQRNELTDRRFLQLNKCPACFGTSWCRRFLNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQSK

SEQ ID NO: 744232 - protein, 322 aa, Homo sapiens; identical to SEQ ID NO: 744231

SEQ ID NO: 744233 - protein, 280 aa, Homo sapiens
MWRLVPPKLGRLSRSLKLAALGSLLVLMVLHSPSLLASWQRNELTDRRFLQLNKCPACFGTSWCRRFLNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQHIPPTHPPYLCVPDGNYRSGWSYIKLCPSFECLTETYAALPFNRNYDKWWRQITEKKQVRR

SEQ ID NO: 744234 - protein, 267 aa, Homo sapiens
MWRLVPPKLGRLSRSLKLAALGSLLVLMVLHSPSLLASWQRNELTDRRFLQLNKCPACFGTSWCRRFLNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQKCLLQRQTEVCVYRADSEENEGICQEIMSDYSDMFQSINAFGGFPNIC

SEQ ID NO: 744235 - protein, 243 aa, Homo sapiens
MWRLVPPKLGRLSRSLKLAALGSLLVLMVLHSPSLLASWQRNELTDRRFLQLNKCPACFGTSWCRRFLNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQAFGLKGWKDGRRKQVAYYVGEFSV

SEQ ID NO: 744236 - protein, 182 aa, Homo sapiens
MPRTEFARLNGDVRLLTPEAVEGWSDLVHCPSQRLLDRLVRRYAETKDSGSFLLRNLKDSERMQLLLTLAFNPEPLVLQSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQSK

SEQ ID NO: 744237 - protein, 337 aa, Homo sapiens
MWRLVPPKLGRLSRSLKLAALGSLLVLMVLHSPSLLASWQRNELTDRRFLQLNKCPALAFFPGPNRKALGLAPAPGRFPVQSVNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQSK

SEQ ID NO: 744238 - protein, 304 aa, Homo sapiens
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALEVGELVKVTKINVSGQWEGECNGKRGHFPFTHVRLLDQQNPDEDFS

SEQ ID NO: 744239 - protein, 304 aa, Homo sapiens; identical to SEQ ID NO: 744238

SEQ ID NO: 744240 - protein, 204 aa, Homo sapiens
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGR

SEQ ID NO: 744241 - protein, 304 aa, Homo sapiens; identical to SEQ ID NO: 744238

SEQ ID NO: 744242 - protein, 304 aa, Homo sapiens; identical to SEQ ID NO: 744238

SEQ ID NO: 744243 - protein, 304 aa, Homo sapiens; identical to SEQ ID NO: 744238

SEQ ID NO: 744244 - protein, 304 aa, Homo sapiens; identical to SEQ ID NO: 744238

SEQ ID NO: 744245 - protein, 304 aa, Homo sapiens; identical to SEQ ID NO: 744238

SEQ ID NO: 744246 - protein, 293 aa, Homo sapiens
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALEVHNVHNVERRDLLQGLLSVLLELCSNADYSIGML

SEQ ID NO: 744247 - protein, 80 aa, Homo sapiens
CREASVWTSWEQSPRHYRAGAGNGLDSGPRQKALCFPSSGEQCCLEPGVRADGKYERKAEVSGRVARGSFSDTQARLTGS

SEQ ID NO: 744248 - protein, 162 aa, Homo sapiens
MAPGYSRRARWPSRAGEPHTRQEDQDASGGASALGCLGNSQSPNNHPPLPEAGFLVCSGYRGGENTVPRFPLLKALFAAAAAAAFGEARSSPQSRRALGLSRGFAWARPPRSPLRFHDLLRAASPPEARRKHHPRRPGPVARPRSSDSLEHPRARARGRGSA

SEQ ID NO: 744249 - protein, 84 aa, Homo sapiens
ETDNFSSVLTIKNCLRRDTGEYQITVSNAAGSKTVAVHLTVLDVPGPPTGPINILDVTPEHMTISWQPPKDDGGSPVINYIVEK

SEQ ID NO: 744250 - protein, 106 aa, Homo sapiens
MANFKLTKRISLIMVLGRDVQIDSCQLVGAGSSTPRHLCPGTRLRCGKAREGGGWQMPEGWEGLHPGGRPWWASLHWGAAGPKIQGDRKHKWCWGSVPHSPWGRGG

SEQ ID NO: 744251 - protein, 1185 aa, Homo sapiens
MADGGEREELLSPSPVSPAKRQCSWPSPQAHHPRGSPGAAGGGAGGVGSSCLVLGARPHLQPDSLLDCAAKTVAEKWAYERVEERFERIPEPVQRRIVYWSFPRNEREICMYSSFQYRGGPGAGAAGGAAGASPAEEGPQPPPGAAAPAGSAPGGVAAGASPGLGAGAGAAGCGGEGLPFRRGIRLLDSGSVENVLQVGFHLSGTVTELATASEPAVTYKVAISFDRCKITSVTCGCGNKDIFYCAHVVALSLYRIRKPDQVKLRLPISETLFQMNRDQLQKFIQYLITAHHTEVLPTAQKLADEILSSNSEINQVNGAPDPTAGASIDDENCWHLDEEQVKEQVKLFLSQGGYCGSGKQLNSMFAKVREMLRMRDSNGARMLTLITEQFVADPRLTLWRQQGTNMTDKCRQLWDELGALWVCIILNPHCKLEEKSCWLQQLQKWSDLDVCPLEDGNYGHELPNITNALPQSAIHSPDSLSRPRRTVFTRAIEGRELHWQDSHLQRIISSDVYTAPACQRESERLLFNSQGQPLWLEHVPTACARVDALRSHGYPKEALRLTVAIINTLRLQQQRQLEIYKHQKKELLQRGTTTITNLEGWVGHPLDPIDCLFLTLTEACRLNDDGYLEMSDMNESRPPVYQHVPVAAGSPNSSESYLSLALEVALMGLGQQRLMPEGLYAQDKVCRNEEQLLSQLQELQLDDELVQTLQKQCILLLEGGPFSGLGEVIHRESVPMHTFAKYLFSALLPHDPDLSYKLALRAMRLPVLENSASAGDTSHPHHMVSVVPSRYPRWFTLGHLESQQCELASTMLTAAKGDTLRLRTILEAIQKHIHSSSLIFKLAQDAFKIATPTDSSTDSTLLNVALELGLQVMRMTLSTLNWRRREMVRWLVTCATEVGVRALVSILQSWYTLFTPTEATSIVAATAVSHTTILRLSLDYPQREELASCARTLALQCAMKDPQSCALSALTLCEKDHIAFEAAYQIAIDAAAGGMTHSQLFTIARYMELRGYPLRAFKLASLAMSHLNLAYNQDTHPAINDVLWACALSHSLGKNELAALIPLVVKSVHCATVLSDILRRCTVTAPGLAGIPGRRSSGKLMSTDKAPLRQLLDATINAYINTTHSRLTHISPRHYGEFIEFLSKARETFLLPQDGHLQFAQFIDNLKQIYKGKKKLMLLVRERFG

SEQ ID NO: 744252 - protein, 1114 aa, Homo sapiens
MLDLPSGHGPSTTPVPLKSGPRRTFARWVLGVCPRLRSQGVPLPRVGAPVEIKADGMTPLEGARGRGAGWCSCCRFQASSAFYSRQVSRGGGPGCGWPRSRTREATFLLQLLTQARRLAGPLPLLRNRFHLSGTVTELATASEPAVTYKVAISFDRCKITSVTCGCGNKDIFYCAHVVALSLYRIRKPDQVKLRLPISETLFQMNRDQLQKFIQYLITAHHTEVLPTAQKLADEILSSNSEINQVNGAPDPTAGASIDDENCWHLDEEQVKEQVKLFLSQGGYCGSGKQLNSMFAKVREMLRMRDSNGARMLTLITEQFVADPRLTLWRQQGTNMTDKCRQLWDELGALWVCIILNPHCKLEEKSCWLQQLQKWSDLDVCPLEDGNYGHELPNITNALPQSAIHSPDSLSRPRRTVFTRAIEGRELHWQDSHLQRIISSDVYTAPACQRESERLLFNSQGQPLWLEHVPTACARVDALRSHGYPKEALRLTVAIINTLRLQQQRQLEIYKHQKKELLQRGTTTITNLEGWVGHPLDPIDCLFLTLTEACRLNDDGYLEMSDMNESRPPVYQHVPVAAGSPNSSESYLSLALEVALMGLGQQRLMPEGLYAQDKVCRNEEQLLSQLQELQLDDELVQTLQKQCILLLEGGPFSGLGEVIHRESVPMHTFAKYLFSALLPHDPDLSYKLALRAMRLPVLENSASAGDTSHPHHMVSVVPSRYPRWFTLGHLESQQCELASTMLTAAKGDTLRLRTILEAIQKHIHSSSLIFKLAQDAFKIATPTDSSTDSTLLNVALELGLQVMRMTLSTLNWRRREMVRWLVTCATEVGVRALVSILQSWYTLFTPTEATSIVAATAVSHTTILRLSLDYPQREELASCARTLALQCAMKDPQSCALSALTLCEKDHIAFEAAYQIAIDAAAGGMTHSQLFTIARYMELRGYPLRAFKLASLAMSHLNLAYNQDTHPAINDVLWACALSHSLGKNELAALIPLVVKSVHCATVLSDILRRCTVTAPGLAGIPGRRSSGKLMSTDKAPLRQLLDATINAYINTTHSRLTHISPRHYGEFIEFLSKARETFLLPQDGHLQFAQFIDNLKQIYKGKKKLMLLVRERFG

SEQ ID NO: 744253 - protein, 1062 aa, Homo sapiens
EQELGSLNNNFRLEQSNNNKKTNNMITERSNCRQVSRGGGPGCGWPRSRTREATFLLQLLTQARRLAGPLPLLRNRFHLSGTVTELATASEPAVTYKVAISFDRCKITSVTCGCGNKDIFYCAHVVALSLYRIRKPDQVKLRLPISETLFQMNRDQLQKFIQYLITAHHTEVLPTAQKLADEILSSNSEINQVNGAPDPTAGASIDDENCWHLDEEQVKEQVKLFLSQGGYCGSGKQLNSMFAKVREMLRMRDSNGARMLTLITEQFVADPRLTLWRQQGTNMTDKCRQLWDELGALWVCIILNPHCKLEEKSCWLQQLQKWSDLDVCPLEDGNYGHELPNITNALPQSAIHSPDSLSRPRRTVFTRAIEGRELHWQDSHLQRIISSDVYTAPACQRESERLLFNSQGQPLWLEHVPTACARVDALRSHGYPKEALRLTVAIINTLRLQQQRQLEIYKHQKKELLQRGTTTITNLEGWVGHPLDPIDCLFLTLTEACRLNDDGYLEMSDMNESRPPVYQHVPVAAGSPNSSESYLSLALEVALMGLGQQRLMPEGLYAQDKVCRNEEQLLSQLQELQLDDELVQTLQKQCILLLEGGPFSGLGEVIHRESVPMHTFAKYLFSALLPHDPDLSYKLALRAMRLPVLENSASAGDTSHPHHMVSVVPSRYPRWFTLGHLESQQCELASTMLTAAKGDTLRLRTILEAIQKHIHSSSLIFKLAQDAFKIATPTDSSTDSTLLNVALELGLQVMRMTLSTLNWRRREMVRWLVTCATEVGVRALVSILQSWYTLFTPTEATSIVAATAVSHTTILRLSLDYPQREELASCARTLALQCAMKDPQSCALSALTLCEKDHIAFEAAYQIAIDAAAGGMTHSQLFTIARYMELRGYPLRAFKLASLAMSHLNLAYNQDTHPAINDVLWACALSHSLGKNELAALIPLVVKSVHCATVLSDILRRCTVTAPGLAGIPGRRSSGKLMSTDKAPLRQLLDATINAYINTTHSRLTHISPRHYGEFIEFLSKARETFLLPQDGHLQFAQFIDNLKQIYKGKKKLMLLVRERFG

SEQ ID NO: 744254 - protein, 1124 aa, Homo sapiens
MLDLPSGHGPSTTPVPLKSGPRRTFARWVLGVCPRLRSQGVPLPRVGAPVEIKADGMTPLEGARGRGAGWCSCCRFQASSAFYSRQVSRGGGPGCGWPRSRTREATFLLQLLTQARRLAGPLPLLRNRFHLSGTVTELATASEPAVTYKVAISFDRCKITSVTCGCGNKDIFYCAHVVALSLYRIRKPDQVKLRLPISETLFQMNRDQLQKFIQYLITAHHTEVLPTAQKLADEILSSNSEINQVNGAPDPTAGASIDDENCWHLDEEQVKEQVKLFLSQGGYCGSGKQLNSMFAKVREMLRMRDSNGARMLTLITEQFVADPRLTLWRQQGTNMTDKCRQLWDELGALWVCIILNPHCKLEEKSCWLQQLQKWSDLDVCPLEDGNYGHELPNITNALPQSAIHSPDSLSRPRRTVFTRAIEGRELHWQDSHLQRIISSDVYTAPACQRESERLLFNSQGQPLWLEHVPTACARVDALRSHGYPKEALRLTVAIINTLRLQQQRQLEIYKHQKKELLQRGTTTITNLEGWVGHPLDPIDCLFLTLTEACRLNDDGYLEMSDMNESRPPVYQHVPVAAGSPNSSESYLSLALEVALMGLGQQRLMPEGLYAQDKVCRNEEQLLSQLQELQLDDELVQTLQKQCILLLEGGPFSGLGEVIHRESVPMHTFAKYLFSALLPHDPDLSYKLALRAMRLPVLENSASAGDTSHPHHMVSVVPSRYPRWFTLGHLESQQCELASTMLTAAKGDTLRLRTILEAIQKHIHSSSLIFKLAQDAFKIATPTDSSTDSTLLNVALELGLQVMRMTLSTLNWRRREMVRWLVTCATEVGVRALVSILQSWYTLFTPTEATSIVAATAVSHTTILRLSLDYPQREELASCARTLALQCAMKDPQSCALSALTLCEKDHIAFEAAYQIAIDAAAGGMTHSQLFTIARYMELRGYPLRAFKLASLAMSHLNLAYNQDTHPAINDVLWACALSHSLGKNELAALIPLVVKSVHCATVLSDILRRCTVTAPGLAGIPGRRSSGKLMSTDKAPLRQLLDATINAYINTTHSRLTHISPRHYGEFIEFLSKARETFLLPQDGHLQFAQFIDNLKQIYKGKKKLMLLVREQIAIVHRERSVTL

SEQ ID NO: 744255 - protein, 103 aa, Homo sapiens
HTRATFLCVGVTVCLVNDSRTYCFLGRPLVHQNCWLYFAGISMPRRWSYQSCSFVPGLEMQCDGLASSAQPMFRLMPRIWILCDHFWLGVRTVYHTVWIGGHS

SEQ ID NO: 744256 - protein, 634 aa, Homo sapiens
GGTAAAATAAPPAAAGARRRQRGKRPRHQRVKTAKTIPSTVVNSIAARLLLQIIRNEPLLLIFIGLEPGVLHSVDFQGKKKTVLVVVIINIWTSVMVKEMRLRNGTVATALAFITSFLTLSWYTTWQNGKEKLIAYQREFLALKERLRIAEHRISQRSSELNTIVQQFKRVGAETNGSKDALNKFSDNTLKLLKELTSKKSLQVPSIYYHLPHLLKNEGSLQPAVQIGNGRTGVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEIHIKKATN

SEQ ID NO: 744257 - protein, 397 aa, Homo sapiens [sequence omitted]

SEQ ID NO: 744258 - protein, 397 aa, Homo sapiens [sequence omitted]

SEQ ID NO: 744259 - protein, 227 aa, Homo sapiens
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKSCIDSWFEVNRSCPEHPAD

SEQ ID NO: 744260 - protein, 183 aa, Homo sapiens
LKVAGPRYALGLQCEPRPCFQLEGRHPLAQDRTLCCLGPAPVESSSPELLPDTQAFQSLTLRATAAQGDNRAWHAVWLVQRRLKAGLGEILGLAPSTEPCLCPRAALTRTRKGNLWPSGRIMPIICLVPVFENAQMLVYKSGSCLGAISVPSLMQRAFLCKHWRAGLHCLAPLPPLAGRTRCC

SEQ ID NO: 744261 - protein, 227 aa, Homo sapiens; identical to SEQ ID NO: 744259

SEQ ID NO: 744262 - protein, 227 aa, Homo sapiens; identical to SEQ ID NO: 744259

SEQ ID NO: 744263 - protein, 269 aa, Homo sapiens
LNVTNTAGTSLPLYARPALPLLLRSGGGSRPPGSRPTGARASMGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKSCIDSWFEVNRSCPEHPAD

SEQ ID NO: 744264 - protein, 227 aa, Homo sapiens; identical to SEQ ID NO: 744259

SEQ ID NO: 744265 - protein, 251 aa, Homo sapiens
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKRDRAPLLQGGGSPDPGAELSLGHQREQGTPSALTSRSWFSLPP

SEQ ID NO: 744266 - protein, 183 aa, Homo sapiens; identical to SEQ ID NO: 744260

SEQ ID NO: 744267 - protein, 227 aa, Homo sapiens; identical to SEQ ID NO: 744259

SEQ ID NO: 744268 - protein, 1704 aa, Homo sapiens
MSSVSEVNVDIKDFLMSINLEQYLLHFHESGFTTVKDCAAINDSLLQKIGISPTGHRRRILKQLQIILSKMQDIPIYANVHKTKKNDDPSKDYHVPSSDQNICIELSNSGSVQTSSPPQLETVRKNLEDSDASVERSQYPQSDDKLSPPKRDFPTAEEPHLNLGSLNDSLFGSDNIKIESLITKKTVDHTVEEQQTEKVKLITENLSKLPNADSECLSFVGCSTSGTNSGNGTNGLLEGSPPSPFFKFQGEMIVNDLYVPSSPILAPVRSRSKLVSRPSRSFLLRHRPVPEIPGSTKGVSGSYFRERRNVATSTEKSVAWQNSNEENSSSIFPYGETFLFQRLENSKKRSIKNEFLTQGEALKGEAATATNSFIIKSSIYDNRKEKISEDKVEDIWIPREDKNNFLIDTASESEYSTVEECFQSLRRKNSKASKSRTQKALILDSVNRHSYPLSSTSGNADSSAVSSQAISPYACFYGASAKKVKSGWLDKLSPQGKRMFQKRWVKFDGLSISYYNNEKEMYSKGIIPLSAISTVRVQGDNKFEVVTTQRTFVFRVEKEEERNDWISILLNALKSQSLTSQSQAVVTPEKCGYLELRGYKAKIFTVLSGNSVWLCKNEQDFKSGLGITIIPMNVANVKQVDRTVKQSFEIITPYRSFSFTAETEKEKQDWIEAVQQSIAETLSDYEVAEKIWFNESNRSCADCKAPDPDWASINLCVVICKKCAGQHRSLGPKDSKVRSLKMDASIWSNELIELFIVIGNKRANDFWAGNLQKDEELHMDSPVEKRKNFITQKYKEGKFRKTLLASLTKEELNKALCAAVVKPDVLETMALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSQAQRKWTEAIAKHFVPLFAENLTEADYDLIGQLFYKDCHALDQWRKGWFAMDKSSLHFCLQMQEVQGDRMHLRRLQELTISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEVKEDQVKQMDIENSFITKWKDTQVSQAGDLLIEVYVERKEPDCSIIIRISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTSWGLTAYSEKHHWHLCCDSSQTQTEWMTSIFIAQHEYDIWPPAGKERKRSITKNPKIGGLPLIPIQHEGNATLARKNIESARAELERLRLSEKCDKESVDSSLKERASMVAHCLEHKDDKLRNRPRKHRSFNCLEDTEPEAPLGQPKGHKGLKTLRKTEDRNSKATLDSDHKLPSRVIEELNVVLQRSRTLPKELQDEQILK

SEQ ID NO: 744269 - protein, 166 aa, Homo sapiens
MALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSFFPSPQ

SEQ ID NO: 744270 - protein, 1704 aa, Homo sapiens; identical to SEQ ID NO: 744268

SEQ ID NO: 744271 - protein, 1704 aa, Homo sapiens; identical to SEQ ID NO: 744268

SEQ ID NO: 744272 - protein, 1640 aa, Homo sapiens
MSSVSEVNVDIKDFLMSINLEQYLLHFHESGFTTVKDCAAINDSLLQKIGISPTGHRRRILKQLQIILSKMQDIPIYANVHKTKKNDDPSKDYHVPSSDQNICIELSNSGSVQTSSPPQLETVRKNLEDSDASVERSQYPQSDDKLSPPKRDFPTAEEPHLNLGSLNDSLFGSDNIKIESLITKKTVDHTVEEQQTEKVKLITENLSKLPNADSECLSFVGCSTSGTNSGNGTNGLLEGSPPSPFFKFQGEMIVNDLYVPSSPILAPVRSRSKLVSRPSRSFLLRHRPVPEIPGSTKGVSGSYFRERRNVATSTEKSVAWQNSNEENSSSIFPYGETFLFQRLENSKKRSIKNEFLTQGEALKGEAATATNSFIIKSSIYDNRKEKISEDKVEDIWIPREDKNNFLIDTASESEYSTVEECFQSLRRKNSKASKSRTQKALILDSVNRHSYPLSSTSGNADSSAVSSQAISPYACFYGASAKKVKSGWLDKLSPQGKRMFQKRWVKFDGLSISYYNNEKEMYSKGIIPLSAISTVRVQGDNKFEVVTTQRTFVFRVEKEEERNDWISILLNALKSQSLTSQSQAVVTPEKCGYLELRGYKAKIFTVLSGNSVWLCKNEQDFKSGLGITIIPMNVANVKQVDRTVKQSFEIITPYRSFSFTAETEKEKQDWIEAVQQSIAETLSDYEVAEKIWFNESNRSCADCKAPDPDWASINLCVVICKKCAGQHRSLGPKDSKVRSLKMDASIWSNELIELFIVIGNKRANDFWAGNLQKDEELHMDSPVEKRKNFITQKYKEGKFRKTLLASLTKEELNKALCAAVVKPDVLETMALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSQAQRKWTEAIAKHFVPLFAENLTEADYDLIGQLFYKDCHALDQWRKGWFAMDKSSLHFCLQMQEVQGDRMHLRRLQELTISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEVKEDQVKQMDIENSFITKWKDTQVSQAGDLLIEVYVERKEPDCSIIIRISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTSWGLTAYSEKHHWHLCCDSSQTQTEWMTSIFIAQHEYDIWPPAGKERKRSITKNPKIGGLPLIPIQHEGNATLARKNIERDPCEHTSSHLEASGSHMVGAGMNWNLDRTSSKLPTTSIQLSPIGSGSSASSLPEDGKV

SEQ ID NO: 744273 - protein, 104 aa, Homo sapiens
GPTQAELLLSGELLTQGELLSTELLLLEAFSWNLCLPTPAHFLDYYLLASVSQKDHHCHTWPTTCPRKTKECLLPGQKVAMPPCFQLKPNLLTCHREQLAPELG

SEQ ID NO: 744274 - protein, 422 aa, Homo sapiens [sequence omitted]

SEQ ID NO: 744275 - protein, 403 aa, Homo sapiens
CEPRRDPSARRGAATAGASRAAEAAVGSAERLGRGSNRRQAPEGTAGSALGGARRSQPPTPREDAVRPESRVASDSGAAYAMMDEPWWEGRVASDVHCTLREKVLDTFEPVLSEKQMGDSPGGAAILGLAGKLRRVWRESLPPIQALRSHFLGQPRLSGGSPDRHPSAPPVLQELKLPTFRAHSPLLKSRRFFVDILTLLSSHCQLCPAARHLAVYLLDHFMDRYNVTTSKQLYTVAVSCLLLASKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVPLFR

SEQ ID NO: 744276 - protein, 67 aa, Homo sapiens
FVLVLESARDKIIYLHEKVQSASGDGDGEAARSFVVVFFSFANLRSIYVQAVWIQVLVSVCSGTWGL

SEQ ID NO: 744277 - protein, 136 aa, Homo sapiens
RAPASSELAELTTFSATFAKGKIKILQVVAQLHIAPCPASRGEGAPQPSADQRRPPAPLSGAGGGARRGPGPGAREDRDTGGRSPGYALAAEVARVHRRVRPESRVASDSGAAYAMMDEPWWEGRVASDVHCTLRE

SEQ ID NO: 744278 - protein, 110 aa, Homo sapiens
MHDCVSSSPHCGPLEEAPLGLDMAFPSSATCGLCLFTLKTSLLVPLRSCPPTLLPVSAVTFIHGSSGHPNAVFLHSTTSFGSVDFSPLFETLTAGFLGRMFFFPSPHPFS

SEQ ID NO: 744279 - protein, 67 aa, Homo sapiens
VLLEKEATDGAIVGQWCPEEGASQTHFMGVEVHEMAFVLQSVSLGQVRWLTPVIPALWEAKAGRSRG

SEQ ID NO: 744280 - protein, 109 aa, Homo sapiens
ICQTHDRWFNRGATAPRELSDKSSFPVQQLLAVFHQKSIHLELPIVIGQVVLLWLPGLRSVEYDIPEISWIFFVSFKNNFCGRPGALAYACNPSTFMRPRRVDHLRSGV

SEQ ID NO: 744281 - protein, 117 aa, Homo sapiens
MLSSLSSFSAHEAEDGACHPEVGLLSAIHPSQVPTAPHCAPCLVRTSLLSHLQSLQTLRPASIPHPPASLSQTPGCTIRSLQVLWNRAFQLVFLGALEFLRCPRSCHSGERAGWKGF

SEQ ID NO: 744282 - protein, 117 aa, Homo sapiens; identical to SEQ ID NO: 744281

SEQ ID NO: 744283 - protein, 333 aa, Homo sapiens
MKGEAGHMLHNEKSKQEGHIWGSMRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRLLHHPTFYKKIHKKHHEWTAPIGVISLYAHPIEHAVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 744284 - protein, 107 aa, Homo sapiens
MPSTNQSPETLTFSRSGSRKFASGTTLGLSVYPTKSLHLPGPCLQSSLLLQVSNMLPVIVGPLVMGSHLSSITMWFSLALIITTISHCGYHLPFLPSPEFHDYHHLK

SEQ ID NO: 744285 - protein, 333 aa, Homo sapiens; identical to SEQ ID NO: 744283

SEQ ID NO: 744286 - protein, 368 aa, Homo sapiens
WRITRPGDRDHPGQHGETLSLLKIQKISRAWWWKPVVPATQEAEQENGVNLGGRACSEPRLCHCTPAWATERDSVSKKKEQTHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRLLHHPTFYKKIHKKHHEWTAPIGVISLYAHPIEHAVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 744287 - protein, 333 aa, Homo sapiens; identical to SEQ ID NO: 744283

SEQ ID NO: 744288 - protein, 333 aa, Homo sapiens; identical to SEQ ID NO: 744283

SEQ ID NO: 744289 - protein, 333 aa, Homo sapiens; identical to SEQ ID NO: 744283

SEQ ID NO: 744290 - protein, 333 aa, Homo sapiens; identical to SEQ ID NO: 744283

SEQ ID NO: 744291 - protein, 333 aa, Homo sapiens; identical to SEQ ID NO: 744283

SEQ ID NO: 744292 - protein, 191 aa, Homo sapiens
MKGEAGHMLHNEKSKQEGHIWGSMRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHR

SEQ ID NO: 744293 - protein, 333 aa, Homo sapiens; identical to SEQ ID NO: 744283

SEQ ID NO: 744294 - protein, 158 aa, Homo sapiens [sequence omitted]

SEQ ID NO: 744295 - protein, 419 aa, Homo sapiens
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 744296 - protein, 407 aa, Homo sapiens
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVLTDISSNRKPKCLSRGHPHSVCNHPDLKSHFHPKGRNHLKKAKDDRASMQPAKAIHEQAESSRDLCRPPKKGELLGFGRKGNIRPKMAKKKPTAIVNII

SEQ ID NO: 744297 - protein, 151 aa, Homo sapiens
MEAAAEKEVQGKARLQDFIENLLQRVELAEKQLEYYQSQQASGFVRDLSGHVLTDISSNRKPKCLSRGHPHSVCNHPDLKSHFHPKGRNHLKKAKDDRASMQPAKAIHEQAESSRDLCRPPKKGELLGFGRKGNIRPKMAKKKPTAIVNII

SEQ ID NO: 744298 - protein, 369 aa, Homo sapiens
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVLTDISSNRKPKCLSRGHPHSVTGSYLQGSSCLDIVFQYSAGPVSCTEVGIFCSRIKEVFRL

SEQ ID NO: 744299 - protein, 124 aa, Homo sapiens
MWVTEWPGRLRLSHRDGCAELPPPGVPGQRFQAGEPDRELPGHTPSASCTATFWVNRSSPSPSPQPPLQPLSRPAFIRRTSLNAVAKKRGAPGRGDPDGHTRNAPPQPREVAHSVQVFGGRVCI

SEQ ID NO: 744300 - protein, 135 aa, Homo sapiens
LSPSRVPVFLMTPTAAAAEAPRPLGGDWAGRAPPHAGIFLSCLGRSGRLVLQSVSPFKKLISCPARSWDHKLACLHSCTFPSVCSSLSGPQGRYPMTWKDAPSRRRSQSGRQETQPSLFCLPPHLSLSLSVLCSC

SEQ ID NO: 744301 - protein, 114 aa, Homo sapiens [sequence omitted]

SEQ ID NO: 744302 - protein, 138 aa, Homo sapiens
MHSGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVSKTQGQQSTL
